(12) United States Patent
McSwiggen

(10) Patent No.: US 7,022,828 B2
(45) Date of Patent: Apr. 4, 2006

(54) SIRNA TREATMENT OF DISEASES OR CONDITIONS RELATED TO LEVELS OF IKK-GAMMA

(75) Inventor: James A. McSwiggen, Boulder, CO (US)

(73) Assignee: Sirna Theraputics, Inc., Boulder, CO (US)

( * ) Notice: Subject to any disclaimer, the term of this patent is extended or adjusted under 35 U.S.C. 154(b) by 354 days.

(21) Appl. No.: 10/156,306

(22) Filed: May 28, 2002

(65) Prior Publication Data

US 2003/0119017 A1    Jun. 26, 2003

Related U.S. Application Data

(60) Provisional application No. 60/294,412, filed on May 29, 2001.

(51) Int. Cl.
*C07H 21/02* (2006.01)

(52) U.S. Cl. .................. 536/23.1; 536/23.5; 514/44

(58) Field of Classification Search ............. 514/44; 536/23.1, 23.5
See application file for complete search history.

(56) References Cited

U.S. PATENT DOCUMENTS

| | | | |
|---|---|---|---|
| 4,987,071 A | 1/1991 | Cech et al. ............. 435/91.31 |
| 5,334,711 A | 8/1994 | Sproat et al. ............ 536/24.5 |
| 5,589,332 A | 12/1996 | Shih et al. ................. 435/6 |
| 5,624,803 A | 4/1997 | Noonberg et al. ............ 435/6 |
| 5,627,053 A | 5/1997 | Usman et al. ............. 435/91.1 |
| 5,631,359 A | 5/1997 | Chowrira et al. .......... 536/24.5 |
| 5,633,133 A | 5/1997 | Long et al. ................. 435/6 |
| 5,670,633 A | 9/1997 | Cook et al. .............. 536/23.1 |
| 5,672,695 A | 9/1997 | Eckstein et al. .......... 536/24.5 |
| 5,716,824 A | 2/1998 | Beigelman et al. ......... 435/366 |
| 5,741,679 A | 4/1998 | George et al. ........... 435/91.31 |
| 5,792,847 A | 8/1998 | Buhr et al. ............... 536/23.1 |
| 5,801,154 A | 9/1998 | Baracchini et al. .......... 514/44 |
| 5,814,620 A | 9/1998 | Robinson et al. ............ 514/44 |
| 5,834,186 A | 11/1998 | George et al. ............... 435/6 |
| 5,849,902 A | 12/1998 | Arrow et al. ............. 536/24.5 |
| 5,871,914 A | 2/1999 | Nathan ..................... 435/6 |
| 5,898,031 A | 4/1999 | Crooke .................... 435/91.3 |
| 5,989,912 A | 11/1999 | Arrow et al. .............. 435/375 |
| 6,001,311 A | 12/1999 | Brennan et al. ............ 422/131 |
| 6,005,087 A | 12/1999 | Cook et al. .............. 536/23.1 |
| 6,107,094 A | 8/2000 | Crooke .................... 435/455 |
| 6,159,714 A | 12/2000 | Usman et al. ........... 435/91.31 |
| 6,476,205 B1 | 11/2002 | Buhr et al. ............... 536/23.1 |
| 6,506,559 B1 | 1/2003 | Fire et al. ................... 435/6 |
| 2002/0012965 A1 | 1/2002 | Strittmatter ............... 435/69.1 |

FOREIGN PATENT DOCUMENTS

| | | |
|---|---|---|
| CA | 2359180 | 3/2000 |
| EP | 0360257 | 3/1990 |

(Continued)

OTHER PUBLICATIONS

Reynolds et al, Nature Biotechnology 22(3), 326 (2004).*

(Continued)

*Primary Examiner*—James Martinell
(74) *Attorney, Agent, or Firm*—McDonnell Boehnen Hulbert & Berghoff LLP

(57) ABSTRACT

The present invention relates to nucleic acid molecules, including antisense and enzymatic nucleic acid molecules, such as hammerhead ribozymes, DNAzymes, allozymes, aptamers, decoys and siRNA (RNAi), which modulate the expression or function of IKK genes, such as IKK-gamma, IKK-alpha, or IKK-beta, and PKR genes.

16 Claims, 4 Drawing Sheets

*Examples of Nuclease Stable Ribozyme Motifs*

FOREIGN PATENT DOCUMENTS

| | | |
|---|---|---|
| EP | 1325955 | 7/2003 |
| JP | 2000253884 | 9/2000 |
| WO | WO 89/02439 | 3/1989 |
| WO | 90/14090 | 11/1990 |
| WO | WO 91/03162 | 3/1991 |
| WO | WO 92/07065 | 4/1992 |
| WO | WO 93/15187 | 8/1993 |
| WO | WO 93/23057 | 11/1993 |
| WO | WO 93/23569 | 11/1993 |
| WO | 94/01550 | 1/1994 |
| WO | WO 94/02595 | 2/1994 |
| WO | 95/04142 | 2/1995 |
| WO | WO 95/04818 | 2/1995 |
| WO | WO 95/11304 | 4/1995 |
| WO | WO 95/11910 | 4/1995 |
| WO | WO 95/13380 | 5/1995 |
| WO | WO 95/23225 | 8/1995 |
| WO | WO 96/10390 | 4/1996 |
| WO | WO 96/10391 | 4/1996 |
| WO | WO 96/10392 | 4/1996 |
| WO | WO 96/19736 | 6/1996 |
| WO | WO 97/26270 | 7/1997 |
| WO | WO 98/13526 | 4/1998 |
| WO | WO 98/27104 | 6/1998 |
| WO | WO 98/28317 | 7/1998 |
| WO | WO 98/43993 | 10/1998 |
| WO | WO 98/58058 | 12/1998 |
| WO | WO 99/04819 | 2/1999 |
| WO | WO 99/05094 | 2/1999 |
| WO | WO 99/16871 | 4/1999 |
| WO | WO 99/29842 | 6/1999 |
| WO | 99/32619 | 7/1999 |
| WO | 99/49029 | 9/1999 |
| WO | 99/53050 | 10/1999 |
| WO | WO 99/54459 | 10/1999 |
| WO | WO 99/55857 | 11/1999 |
| WO | 99/61631 | 12/1999 |
| WO | WO 00/24931 | 5/2000 |
| WO | WO 00/26226 | 5/2000 |
| WO | 00/44914 | 8/2000 |
| WO | 00/49035 | 8/2000 |
| WO | 00/63364 | 10/2000 |
| WO | 01/36646 | 5/2001 |
| WO | 01/57206 | 8/2001 |
| WO | 01/96584 | 12/2001 |
| WO | 01/097850 | 12/2001 |
| WO | 02/07747 | 1/2002 |
| WO | 02/10378 | 2/2002 |
| WO | 02/22636 | 3/2002 |
| WO | 02/096927 | 12/2002 |
| WO | 03/068797 | 8/2003 |
| WO | 03/070910 | 8/2003 |
| WO | 03/080638 | 10/2003 |
| WO | 04/043977 | 5/2004 |
| WO | 04/072261 | 8/2004 |
| WO | WO 95/06731 | 3/2005 |

OTHER PUBLICATIONS

Abramovitz et al., "Catalytic Role of 2'-Hydroxyl Groups Within a Group II Intron Active Site," *Science* 271:1410-1413 (1996).

Akhtar and Juliano, Cellular Uptake and Intracellular Fate of AntiSense Oligonucleotides, *Trends Cell Biol.* 2:139-144 (1992).

Aldrian-Herrada et al., "A peptide nucleic acid (PNA) is more rapidly internalized in culture neurons when coupled to a *retro-inverso* delivery peptide. The antisense activity depresses the target mRNA and protein in magnocellular oxytocin neurons," *Nucleic Acids Research* 26:4910-4916 (1998).

Banerjee and Turner, "The Time Dependence of Chemical Modification Reveals Slow Steps in the Folding of a Group I Ribozyme," *Biochemistry* 34:6504-6512 (1995).

Bartel and Szostak," Isolation of New Ribozymes from a Large Pool of Random Sequences," *Science* 261:1411-1418 (1993).

Bass, "The short answer," *Nature* 411:428-429 (2001).

Beaudry and Joyce, "Directed Evolution of an RNA Enzyme," *Science* 257:635-641 (1992.

Beigelman et al., "Chemical Modification of Hammerhead Ribozymes," *The Journal of Biological Chemistry* 270: 24702-24708 (1995).

Bellas et al., "Inhibition of NF-$_\kappa$B Activity Induces Apoptosis in Murine Hepatocytes," *American Journal of Pathology* 151:891-896 (1997).

Bellon et al., "Amino-Linked Ribozymes: Post-Synthetic Conjugation of Half-Ribozymes," *Nucleosides & Nucleotides* 16:951-954 (1997).

Bellon et al., "Post-synthetically Ligated Ribozymes: An Alternative Approach to Iterative Solid Phase Synthesis," *Bioconjugate Chem.* 8:204-212 (1997).

Berzal-Herranz et al., "Essential nucleotide sequences and secondary structure elements of the hairpin ribozyme," *EBMO J.* 12:2567-2574 (1993).

Berzal-Herranz et al., "In vitro selection of active hairpin ribozymes by sequential RNA-catalyzed clevage and ligation reactions," *Genes & Development* 6:129-134 (1992).

Bevilacqua et al., "A Mechanistic Framework for the Second Step of Splicing Catalyzed by the *Tetrahymena* Ribozyme," *Biochemistry* 35:648-568 (1996).

Blesch, "Delivery of Neurotrophic Factors to Neuronal Targets: Toward Gene Therapy in the CNS," *Drug News & Perspectives* 13:269-280 (2000).

Boado et al., "Drug Delivery of Antisense Molecules to the Brain for Treatment of Alzheimer's Disease and Cerebral AIDS," *Journal of Pharmaceutical Sciences* 87:1308-1315 (1998).

Boado, "Antisense drug delivery through the blood-brain barrier," *Advanced Drug Delivery Reviews* 15:73-107 (1995).

Breaker and Joyce, "Inventing and improving ribozyme function: rational design versus iterative selection methods," *TIBTECH* 12:268-275 (1994).

Breaker et al., "A DNA enzyme with $Mg^2$-dependent RNA phosphoesterase activity," *Chemistry & Biology* 2(10):655-660 (1995).

Breaker, "Are engineered proteins getting competition from RNA?" *Current Opinion in Biotechnology* 7:442-448 (1996).

Breaker, "Catalytic DNA: in training and seeking employment," *Nature Biotechnology* 17:422-423 (1999).

Brennan et al., "Two-Dimensional Parallel Array Technology as a New Approach to Automated Combinatorial Solid-Phase Organic Synthesis," *Biotechnology and Bioengineering (Combinatorial Chemistry)* 61:33-45 (1998).

Brody and Gold, "Aptamers as therapeutic and diagnostic agents," *Reviews in Molecular Biotechnology* 74:5-13 (2000).

Burgin et al., "Chemically Modified Hammerhead Ribozymes with Improved Catalytic Rates," *Biochemistry* 35:14090-14097 (1996) (vol. No. mistakenly listed as 6).

Burlina et al., "Chemical Engineering of RNase Resistant and Catalytically Active Hammerhead Ribozymes," *Bioorganic & Medicinal Chemistry* 5:1999-2010 (1997).
Caruthers et al., "Chemical Synthesis of Deoxyoligonucleotides and Deoxyoligonucleotide Analogs," *Methods in Enzymology* 211:3-19 (1992).
Cech, "Ribozymes and Their Medical Implications," *JAMA* 260:3030-3034 (1988).
Chartrand et al., "An oligodeoxyribonucleotide that supports catalytic activity in the hammerhead ribozyme domain," *Nucleic Acids Research* 23(20):4092-4096 (1995).
Chen et al., "Multitarget-Ribozyme Directed to Cleave at up to Nine Highly Conserved HIV 1 env RNA Regions Inhibits HIV-1 Replication-Potential Effectiveness Against Most Presently Sequenced HIV-1 Isolates," *Nucleic Acids Research* 20:4581-4589 (1992).
Chowrira et al., "In Vitro and in Vivo Comparison of Hammerhead, Hairpin, and Hepatitis Delta Virus Self-Processing Ribozyme Cassettes," *J. Biol. Chem.* 269:25856-25864 (1994.
Chowrira et al., "Novel guanosine requirement for catalysis by the hairpin ribozyme," *Nature* 354:320-322 (1991).
Christoffersen and Marr, "Riobozymes as Human Therapeutic Agents," *J. Med. Chem.* 38:2023-2037 (1995) (also referred to as Christofferson and Marr).
Christoffersen et al., "Application of computational technologies to ribozyme biotechnology products," *Journal of Molecular Structure (Theochem)* 311:273-284 (1994).
Cload and Schepartz, "Polyther Tethered Oligonucleotide Probes," *J. Am. Chem. Soc.* 113:6324-6326 (1991).
Collins and Olive, "Reaction Conditions and Kinetics of Self-Cleavage of Ribozyme Derived From *Neurospora* VS RNA," *Biochemistry* 32:2795-2799 (1993).
Couture and Stinchcomb, "Anti-gene therapy: the use of ribozymes to inhibit gene function," *Trends In Genetics* 12:510-515 (1996).
Crooke, "Advances in Understanding the Pharmacological Properties of Antisense Oligonucleotides," *Advances in Pharmacology* 40:1-49 (1997).
Crooke, "Antisense Therapeutics," *Biotechnology and Genetic Engineering Reviews* 15:121-157 (1998).
Crooke, "Progress in Antisense Technology: The End of the Beginning," *Methods in Enzymology* 313:3-45 (1999).
Daniels et al., "Two Competing Pathways for Self-splicing by Group II Introns: A Quantitative Analysis of in Vitro Reaction Rates and Products," *J. Mol. Biol.* 256:31-49 (1996).
Delihas et al., "Natural antisense RNA/target RNA interactions: Possible models for antisense oligonucleotide drug design," *Nature Biotechnology* 15:751-753 (1997).
Dreyfus, "Restriction Ribozymes?" *Einstein Quarterly Journal of Biology and Medicine* 6:92-93 (1988).
Dropulic et al., "Functional Characterization of a U5 Ribozyme: Intracellular Suppression o Human Immunodeficiency Virus Type I Expression," *Journal of Virology* 66:1432-1441 (1992).
Durand et al., "Circular Dichroism Studies of an Oligodeoxyribonucleotide Containing a Hairpin Loop Made of a Hexaethylene Glycol Chain: Conformation and Stability," *Nucleic Acids Research* 18:6353-6359 (1990).
Duval-Valentin, "Specific inhibition of transcription by triple helix-forming oligonucleotides," *Proc. Natl. Acad. Sci. USA* 89:504-508 (1992).

Earnshaw et al., "Modified Oligoribonucleotides as Site-Specific Probes of RNA Structure and Function," *Biopolymers* 48:39-55 (1998).
Eck et al., "Inhibition of Phorbol Ester-Induced Cellular Adhesion by Competitive Binding o $NF\text{-}_{\kappa}B$ In Vivo," *Mol. Cell. Biol.* 13:6530-6536 (1993).
Egholm et al., "PNA hybridizes to complementary oligonucleotides obeying the Watson-Crick hydrogen-bonding rules," *Nature* 365:566-568 (1993).
Elbashir et al., "Duplexes of 21-nucleotide RNAs mediate RNA interference in cultured mammalian cells," *Nature* 411: 494-498 (2001).
Elkins and Rossi, "Ch. 2 —Cellular Delivery of Ribozymes," *Delivery Strategies for Antisense Oligonucleotide Therapeutics*, edited by Akhtar, CRC Press, pp. 17-220 (1995).
Elroy-Stein and Moss, "Cytoplasmic Expression System Based on Constitutive Synthesis of Bacteriophage T7 RNA Polymerase in Mammalian Cells," *Proc. Natl. Acad. Sci. USA* 87:6743-6747 (1990).
Emerich et al., "Biocompatability of Poly (DL-Lactide-*co*-Glycolide) Microspheres Implante Into the Brain," *Cell Transplantation* 8:47-58 (1999).
Feldstein et al., "Two sequences participating in the autolytic processing of satellite tobacco ringspot virus complementary RNA," *Gene* 82:53-61 (1989).
Ferentz and Verdine, "Disulfied Cross-Linked Oligonucleotides," *J. Am. Chem. Soc.* 113:4000-4002 (1991).
Forster and Altman, "External Guide Sequences for an RNA Enzyme," *Science* 249:783-786 (1990).
Fox, "Targeting DNA with Triplexes," *Current Medicinal Chemistry* 7:17-37 (2000).
Freier et al., "Improved free-energy parameters for predictions of RNA duplex stability," *Proc. Natl. Acad. Sci. USA* 83:9373-9377 (1986).
Gao and Huang, "Cytoplasmic Expression of a Reporter Gene by Co-Delivery of T7 RNA Polymerase and T7 Promoter Sequence with Cationic Liposomes," *Nucleic Acids Research* 21:2867-2872 (1993).
Gold et al., "Diversity of Oligonecleotide Functions," *Annu. Rev. Biochem.* 64:763-797 (1995).
Gold, "Axonal Regeneration of Sensory Nerves is Delayed by Continuous Intrathecal Infusion of Nerve Growth Factor," *Neuroscience* 76:1153-1158 (1997).
Good et al., "Expression of small, therapuetic RNAs in human nuclei," *Gene Therapy* 4:4554 (1997).
Grasby et al., "Purine Functional Groups in Essential Residues of the Hairpin Ribozyme Required for Catalytic Cleavage of RNA," *Biochemistry* 34:4068-4076 (1995).
Griffin et al., "Group II intron ribozymes that cleave DNA and RNA linkages with similar efficiency, and lack contacts with substrate 2'-hydroxyl groups," *Chemistry & Biology* 2:761-770 (1995).
Groothuis and Levy, "The entry of antiviral and antiretroviral drugs into the central nervous system," *Journal of NeuroVirology* 3:387-400 (1997).
Guerrier-Takada et al., "The RNA Moiety of Ribonuclease P Is the Catalytic Subunit of the Enzyme," *Cell* 35:849-857 (1983).
Guo and Collins, "Efficent *trans*-cleavage of a stem-loop RNA substrate by a ribozyme derived from *Neurospora* VS RNA," *EMBO J.* 14:368-376 (1995).

Hagihara et al., "Widespread gene transfection into the central nervous system of primates," *Gene Therapy* 7:759-763 (2000).

Hammann et al., "Length Variation of Helix III in a Hammerhead Ribozyme and Its Influence on Cleavage Activity," *Antisense & Nucleic Acid Drug Development* 9:25-31 (1999).

Hampel and Tritz, "RNA Catalytic Properties of the Minimum (-)s TRSV Sequence," *Biochemistry* 28:4929-4933 (1989).

Hampel et al., "'Hairpin'Catalytic RNA Model: Evidence for Helices and Sequence Requirement for Substrate RNA," *Nucleic Acids Research* 18:299-304 (1990).

Harris et al., "Identification of phosphates involves in catalysis by the ribozyme RNase P RNA," *RNA* 1:210-218 (1995).

Haseloff and Gerlach, "Sequences required for self-catalysed cleavage of the satellite RNA of tobacco ringspot virus," *Gene* 82:43-52 (1989).

Haseloff and Gerlach, "Simple RNA Enzymes with New and Highly Specific Endoribonuclease," *Nature* 334:585-591 (1988).

Hegg et al., "Kinetics and Thermodynamics of Intermolecular Catalysis by Hairpin Ribozymes," *Biochemistry* 34:15813-15828 (1995).

Hermann and Patel, "Adaptive Recognition by Nucleic Acid Aptamers," *Science* 287:820-825 (2000).

Herrlinger et al., HSV-1 Vectors for Gene Theerapy of Experimental CNS Tumors, *Methods Mol. Med.*, 35, 287-312 (2000).

Herschlag and Cech, "Catalysis of RNA Cleavage by the *Tetrahymena thermophila* Ribozyme 1. Kinetic Description of the Reaction of an RNA Substrate Complementary to the Active Site," *Biochemistry* 29:10159-10171 (1990).

Herschlag and Cech, "Catalysis of RNA Cleavage by the *Tetrahymena thermophila* Ribozyme. 2. Kinetic Description of the Reaction of an RNA Substrate That Forms a Mismatch at the Active Site," *Biochemistry* 29:10172-10180 (1990).

Hertel et al., "A Kinetic Thermodynamic Framework for the Hammerhead Ribozyme Reaction," *Biochemistry* 33:3374-3385 (1994).

Hertel et al., "Numbering System for the Hammerhead," *Nucleic Acids Research* 20:3252 (1992).

Hunziker et al., "Nucleic Acid Analogues: Synthesis and Properties, in Modern Synthetic Methods," *VCH*, 331-417.

Ishiwata et al., "Physical-Chemistry Characteristics and Biodistribution of Poly(ethyleneglycol)-Coated Liposomes Using Poly(oxyethylene) Cholesteryl Ether," *Chem. Pharm. Bul* 43:1005-1011 (1995).

Izant and Weintraub, "Constitutive and Conditional Suppression of Exogenous and Endogeneous Genes by Anti-Sense RNA," *Science* 229:345-352 (1985).

Jaeger et al., "Improved Predictions of Secondary Structures for RNA," *Proc. Natl. Acad. Sci. USA* 86:7706-7710 (1989).

Jarvis et al., "Optimizing the Cell Efficacy of Synthetic Ribozymes," *Journal of Biological Chemistry* 271:29107-29112 (1996).

Jaschke et al., "Automated Incorporation of Polyethylene Glycol into Synthetic Oligonucleotides," *Tetrahedron Letters* 34:301-304 (1993).

Jayasena, "Aptamers: An Emerging Class of Molecules that Rival Antibodies in Diagnostics," *Clinical Chemistry* 45:1628-1650 (1999).

Jeffries and Symons, "A Catalytic 13-mer Ribozyme," *Nucleic Acids Research* 17:1371-1377 (1989).

Jolliet-Riant and Tillement, "Drug transfer across the blood-brain barrier and improvement of brain delivery," *Fudam. Clin. Pharmacol.* 13:16-26 (1999).

Joseph et al., "Substrate selection rules for the hairpin ribozyme determined by in vitro selection, mutation, and analysis of mismatched substrates," *Genes & Development* 7:130-138 (1993).

Joyce et al., "Amplification, mutation and selection of catalytic RNA," *Gene* 82:83-87 (1989).

Joyce, "Directed Molecular Evolution," *Scientific American* 267:90-97 (1992).

Karpeisky et al, "Highly Efficient Synthesis of 2'-O-Amino Nucleosides And Their Incorporation in Hammerhead Ribozymes," *Tetrahedron Letters* 39:1131-1134 (1998).

Kashani-Sabet et al., "Reversal of the Malignant Phenotype by an Anti-*ras* Ribozyme," *Antisense Research & Development* 2:3-15 (1992).

Kim and Cech, "Three-dimensional model of the active site of the self-splicing rRNA precursor of *Tetrahymena*," *Proc. Natl. Acad. Sci. USA* 84:8788-8792 (1987).

Kitajima et al., "Ablation of Tranplanted HTLV-I Tax-Transformed Tumors in Mice by Antisense Inhibition of NF-$_\kappa$B," *Science* 258:1792-1795 (1992).

Knitt et al., "ph Dependencies of the *Tetrahymena* Ribozyme Reveal an Unconvential Origin of an Apparent p$K_a$," *Biochemistry* 35:1560-1570 (1996).

Kore, et al., "Sequence specificity of the hammerhead ribozyme revisistsed; the NIH rule," *Nucleic Acids Research*, 26(18):4116-4120 (1998).

Krappmann et al., The IκB Kinase (IKK) Complex is Tripartite and Contains IKKγ but Not IKAP as a Regular Component J. Biol. Chem. 2000 275:29779-29787.

Kumar and Ellington, "Artificial evolution and natural ribozymes," *FASEB J.* 9:1183-1195 (1995).

Kunsch and Rosen, "NF-$_\kappa$B Subunit-Specific Regulation of the Interleukin-8 Promoter," *Mol. Cell. Biol.* 13:6137-6146 (1993).

Kusser, "Chemically modified nucleic acid aptamers for in vitro selections: evolving evolution," *Reviews in Molecular Biotechnology* 74:27-38 (2000).

Lasic and Needham "The 'Stealth' Lipsome: A Prototypical Biomaterial," *Chemical Reviews* 95:2601-2627 (1995).

Lasic and Papahadjopoulos, "Liposomes Revisited," *Science* 267:1275-1276 (1995).

Lenardo and Baltimore, "NF-$_\kappa$B: A Pleiotropic Mediator of Inducible and Tissue Specific Gene Control," *Cell* 58:227-229 (1989).

Li and Altman, "Cleavage by RNase P of gene N mRNA reduces bacteriophage λ burst size," *Nucleic Acids Research* 24:835-842 (1996).

Li et al., "Thermodynamic and Activation Parameters for Binding of a Pyrene-Labeled Substrate by the *Tetrahymena* Ribozyme: Docking is Not Diffusion-Controlled and is Driven by a Favorable Entropy Change," *Biochemistry* 34:14394-14399 (1995).

Leiber et al., "Stable High-Level Gene Expression in Mammalian Cells by T7 Phage RNA Polymerase," *Methods Enzymol.* 217:47-66 (1993).

Lim et al., "Nuclear Factor-κB Regulats Cyclooxygenase-2 Expression and Cell Proliferation in Human Gastric Cancer Cells," *Laboratory Investigation* 81:349-360 (2001).

Limbach et al., "Summary: the modified nucleosides of RNA," *Nucleic Acids Research* 22(12):2183-2196 (1994).

Lisacek et al., "Automatic Identification of Group I Intron Cores in Genomic DNA Sequences," *J. Mol. Biol.* 235:1206-1217 (1994).

Lisziewicz et al., "Inhbition of Human Immunodeficiency Virus Type 1 Replication by Regulated Expression of a Polymeric Tat Activation Response RNA Decoy as a Strategy for Gene Therapy in AIDS," *Proc. Natl. Acad. Sci. U.S.A.* 90:8000-8004 (1993).

Liu et al., "Cationic Liposome-mediated Intravenous Gene Delivery," *J. Biol. Chem.* 270(42):24864-24870 (1995).

Liu et al., "Specific NF-$_\kappa$B Subunits Act in Concert with Tat To Stimulate Human Immunodeficiency Virus Type 1 Transcription," *J. Virology* 66:3883-3887 (1992).

Ma et al., "Design and Synthesis of RNA Miniduplexes via a Synthetic Linker Approach. 2. Generation of Covalently Closed, Double-Stranded Cyclic HIV-1 TAR RNA Analogs with High Tat-Binding Affinity," *Nucleic Acids Research* 21:2585-2589 (1993).

Ma et al., "Design and Synthesis of RNA Miniduplexes via a Synthetic Linker Approach," *Biochemistry* 32:1751-1758 (1993).

Maher et al., "Kinetic Analysis of Oligodeoxyribonucleotide-Directed Triple-Helix Formation on DNA," *Biochemistry* 29:8820-8826 (1990).

McCurdy et al., "Deoxyoligonucleotides with Inverted Polarity: Synthesis and Use in Triple-Helix Formation" *Nucleosides & Nucleotides* 10:287-290 (1991).

McGarry and Lindquist, "Inhibition of heat shock protein synthesis by heat-inducible antisense RNA," *Proc. Natl. Acad. Sci. USA* 83:399-403 (1986).

McKay, "Structure and function of the hammerhead ribozyme: an unfinished story," *RNA* 2:395-403 (1996).

Mesmaeker et al, "Novel Backbone Replacements for Oligonucleotides," *American Chemical Society*, pp. 24-39 (1994).

Michel and Westhof, "Slippery substratrates," *Nat. Struct. Biol.* 1:5-7 (1994).

Michel et al., "Structure and Activities of a Group II Introns," *Annu. Rev. Biochem.* 64:435-461 (1995).

Michels and Pyle, "Conversion of a Group II Intron into a New Multiple-Turnover Ribozyme that Selectively Cleaves Oligonucleotides: Elucidation of Reaction Mechanism and Structure/Function Relationships," *Biochemistry* 34:2965-2977 (1995).

Milligan and Uhlenbeck, "Synthesis of Small RNAs Using T7 RNA Polymerase," *Methods Enzymol.* 180:51-62 (1989).

Milner et al., "Selecting effective antisense reagents on combinatorial oligonucleotide arrays," *Nature Biotechnology* 15:537-541 (1997).

Moore and Sharp, "Site-Specific Modification of Pre-mRNA: The 2'-Hydroxyl Groups at the Splice Sites," *Science* 256:992-996 (1992).

Mukhopadhyay et al., "Antisense Regulation of Oncogenes in Human Cancer," *Critical Reviews in Oncogenesis* 7:151-190 (1996).

Narayanan et al., "Evidence for Differential Functions of the p50 and p65 Subunits of NF-$_\kappa$B with a Cell Adhesion Model," *Mol. Cell. Biol.* 13:3802-3810 (1993).

Nathans and Smith, "Restriction Endonucleases in the analysis and Restruturing of DNA Molecules," *Ann. Rev. Biochem.* 44:273-293 (1975).

Noonberg et al., In vivo generation of higly abundant sequence-specific oligonucleotides for antisense and triplex gene regulation, *Nucleic Acids Research* 22(14):2830-2836 (1994).

Ohkawa et al., "Activities of HIV-RNA Targeted Ribozymes Transcribed From a 'Shot-Gun Type Ribozyme-trimming Plasmid," *Nucleic Acids Symp. Ser.* 27:15-16 (1992).

Ojwang et al., "Inhibition of Human Immunodeficiency Virus Type 1 Expression by a Hairpin Ribozyme," *Proc. Natl. Acad. Sci. USA* 89:10802-10806(1992).

Oku et al., "Real-time analysis of liposomal trafficking in tumor-bearing mice by use of positron emission tomography," *Biochimica et Biophysica Acta* 1238:86-90 (1995).

Ono et al., "DNA Triplex Formation of Oligonucleotide Analogues Consisting of Linker Groups and Octamer Segments That Have Opposite Sugar-Phosphate Backbone Polarities," *Biochemistry* 30:9914-9921 (1991).

Orgel, "Selection in vitro," *Proc. R. Soc. London B.* 205:435-442 (1979).

Pan et al., "Probing of tertiary interactions in RNA: 2'-Hydroxyl-base contacts between the Rnase P and pre-tRNA," *Proc. Natl. Acad. Sci. USA* 92:12510-12514 (1995).

Pardridge et al., "Vector-mediated delivery of a polyamide ("peptide") nucleic acid analogue through the blood-brain barrier in vivo," *Proc. Natl. Acad. Sci. USA* 92:5592-559 (1995).

Peel and Klein, "Adeno-associated virus vectors: activity and applications in the CNS," *Journal of Neuroscience Methods* 98:95-104 (2000).

Perkins et al., "Distinct combinations of NF-$_\kappa$B subunits determine the specificity of transcriptional activation," *Proc. Natl. Acad. Sci. USA* 89:1529-1533 (1992).

Perreault et al., "Mixed Deoxyribo- and Robo-Oligonucleotides with Catalytic Activity," *Nature* 344:565-567 (1990).

Perrotta and Been, "A pseudoknot-like structure required for efficient self-cleavage of hepatitis delta virus RNA," *Nature* 350:434-436 (1991).

Perrotta and Been, "Cleavage of Oligoribonucleotides by a Ribozyme Derived from the Hepatitis $\delta$ Virus RNA Sequence," *Biochemistry* 31:16-21 (1992).

Peterson et al., "Future Prospects of Gene Therapy for Treating CNS Diseases," *Central Nervous System Diseases* Chapter 24:485-508 (2000).

Pianetti et al., "Her-2/neu overexpression induces NF-κB via a Pl3-kinase/Akt pathway involving calpain-mediated degradation of lκB-α that can be inhibited by the tumor suppressor PTEN," *Oncogene* 20:1287-1299 (2001).

Pieken et al., "Kinetic Characterization of Ribonuclease-Resistant 2'-Modified Hammerhea Ribozymes," *Science* 253:314-317 (1991).

Praseuth et al., "Triple helix formation and the antigene for sequence-specific control of gene expression," *Biochimica et Biophysica Acta* 1489:181-206 (1999).

Puttaraju et al., "A circular trans-acting hepatitis delta virus ribozyme," *Nucleic Acids Research* 21:4253-4258 (1993).

Pyle et al., "Building a Kinetic Framework for Group II Intron Ribozyme Activity: Quantitation of Interdomain Binding and Reaction Rate," *Biochemistry* 33:2716-2725 (1994).

Ray and Prefontaine, "Physical association and functional antagonism between the p65 subunit of transcription factor NF-$_\kappa$B and the glucocorticoid receptor," *Proc. Natl. Acad. Sci. USA* 91:752-756 (1994).

Read et al., "NF-$_\kappa$B and I$_\kappa$B$_\alpha$: An Inducible Regulatory System in Endothelial Activation," *J. Exp. Med.* 179:503-512 (1994).

Richardson and Schepartz, "Tethered Oligonucleotide Probes. A Strategy for the Recognition of Structured RNA," *J. Am. Chem. Soc.* 113:5109-5111 (1991).

Robertson et al., "Purification and Properties of a Specific *Escherichia coli* Riobnuclease which Cleaves a Tyrosine Transfer Ribonucleic Acid Precursor," *J. Biol. Chem.* 247:5243-5251 (1972).

Rossi et al., "Ribozymes as Anti-HIV-1 Therapeutic Agents: Principles, Applications, and Problems," *Aids Research and Human Retroviruses* 8:183-189 (1992).

Santoro and Joyce, "A general purpose RNA-cleaving DNA enzyme," *Proc. Natl. Acad. Sci. USA* 94:4262-4266 (1997).

Santoro et al., "Mechanism and Utility of an RNA-Cleaving DNA Enzyme," *Biochemistry* 37:13330-13342 (1998).

Santoro et al., "RNA Cleavage by a DNA Enzyme with Extended Chemical Functionality," *J. Am. Chem. Soc.* 122:2433-2439 (2000).

Sarver et al., "Ribozymes as Potential Anti-HIV-1 Therapeutic Agents" *Science* 247:1222-1225 (1990).

Savill and Collins, "A Site-Specific Self-Cleavage Reaction Performed by a Novel RNA In Neurospora Mitochondria," *Cell* 61:685-696 (1990).

Saville and Collins, "RNA-Mediated Ligation of Self-Cleavage Products of a *Neurospora* Mitochondria Plasmid Transcript," *Proc. Natl. Acad. Sci. USA* 88:8826-8830 (1991).

Scanlon et al., "Ribozyme-Mediated Cleavage of c-fos mRNA Reduces Gene Expression of DNA Synthesis Enzymes and Metallothionein," *Proc. Natl. Acad. Sci. USA* 88:10591-10595 (1991).

Scaringe et al., "Chemical synthesis of biologically active oligoribonucleotides using β-cyanoethyl protected ribonucleoside phosphoramidites," *Nucl Acids Res.* 18:5433-5441 (1990).

Schmajuk et al., "Antisense Oligonucleotides with Different Backbones," *The Journal of Biological Chemistry* 274:21783-21789 (1999).

Schmidt et al., "Base and sugar requirements for RNA cleavage of essential nucleoside residues in internal loop B of the hairpin ribozyme: implications for secondary structure," *Nucleic Acids Research* 24:573-581 (1996).

Schroeder et al., "Diffusion Enhancement of Drugs by Loaded Nanoparticles in Vitro," *Pro Neuro-Psychopharmacol. & Biol. Psychiat.* 23:941-949 (1999).

Scott et al., "The crystal structure of an All-RNA hammerhead ribozyme: A proposed mechanism for RNA catalytic cleavage," *Cell* 81:991-1002 (1995).

Seela and Kaiser, "Oligodeoxyribonucleotides containing 1,3-propanediol as nucleoside substitute," *Nucleic Acids Research* 15:3113-3129 (1987).

Shabarova et al., "Chemical ligation of DNA: The first non-enyzmatic assembly of a biologically active gene," *Nucleic Acids Research* 19:4247-4251 (1991).

Silverman et al., "Selective RNA Cleavage by Isolated RNase L Activated with 2-5A Antisense Chimeric Oligonucleotides," *Methods in Enzymology* 313:522-533 (1999).

Sovak et al., "Aberrant Nuclear Factor-$_k$B/Rel Expression and the Pathogenesis of Breast Cancer," *J. Clin. Invest.* 100:2952-2960 (1997).

Stein and Cheng, "Antisense Oligonucleotides as Theapeutic Agents —Is the Bullet Really Magical?" *Science* 261:1004-1288 (1993).

Stein et al., "A Specificity Comparison of Four Antisense Types: Morpholino, 2'-O-Methyl RNA, DNA, and Phosphorothioate DNA," *Antisense & Nucleic Acid Drug Development* 7:151-157 (1997).

Strobel and Dervan, "Site-Specific Cleavage of a Yeast Chromosome by Oligonucleotide-Directed Triple-Helix Formation," *Science* 249:73-75 (1990).

Strobel et al., "Exocylic Amine of the Conserved G.U Pair at the Cleavage Site of the *Tetrahymena* Ribozyme Contributes to 5'-Splice Site Selection and Transition State Stabilization," *Biochemistry* 35:1201-1211 (1996).

Strobel et al., "Minor Groove Recognition of the Conserved G.U Pair at the *Tetrahymena* Ribozyme Reaction Site," *Science* 267:675-679 (1995).

Sullenger and Cech, "Ribozyme-mediated repair of defective mRNA by targeted trans-splicing," *Nature* 371:619-622 (1994).

Sullenger and Cech, "Tethering Ribozymes to a Retroviral Packaging Signal for Destruction of Viral RNA," *Science* 262:1566-1569 (1993).

Sullenger et al., "Overexpression of TAR Sequences Renders Cells Resistant to Human Immunodeficiency Virus Replication," *Cell* 63:601-608 (1990).

Sun, "Technology evaluation: SELEX, Giliad Sciences Inc," *Current Opinion in Molecular Therapeutics* 2:100-105 (2000).

Szostak and Ellington, "Ch. 20 —In Vitro Selection of Functional RNA Sequences,"in *The RNA World*, edited by Gesteland and Atkins, Cold Spring Harbor Laboratory Press, pp. 511-533 (1993).

Szostak, In Vitro Genetics, TIBS 17:89-93 (1993).

Taira et al., "Construction of a novel RNA-transcript-trimming plasmid which can be used both in vitro in place of run-off and (G)-free transcriptions and in vivo as multisequences transcription vectors," *Nucleic Acids Research* 19:5125-5130 (1991).

Tang et al., "Examination of the catalytic fitness of the hammerhead ribozyme by in vitro selection," *RNA* 3:914-925 (1997).

Thompson et al., "Improved accumulation and activity of ribozymes expressed from a tRNA-based RNA polymerase III promoter," *Nucleic Acids Research* 23:2259-2268 (1995).

Torrence et al., "Targeting RNA for degradation with a (2'-5') oligoadenylate-antisense chimera," *Proc. Natl. Acad. Sci. USA* 90:1300-1304 (1993).

Turner et al., "Improved Parameters for Prediction of RNA Structure," *Cold Spring Harbor Symposia on Quantitative Biology* vol. LII, pp. 123-133 (1987).

Turner et al., "Free Energy Increments for Hydrogen Bonds in Nucleic Acid Base Pairs," *J. Am. Chem. Soc.* 109:3783-3785 (1987).

Tyler et al., "Peptide nucleic acids targeted to the neurotensin receptor and administered i.p. cross the blood-brain barrier and specifically reduce gene expression," *Proc. Natl. Acad. Sci. USA* 96:7053-7058 (1999).

Tyler et al., "Specific gene blockade shows that peptide nucleic acids readily enter neuronal cells in vivo," *FEBS Letters* 421:280-284 (1998).

Uhlenbeck, "A Small Catalytic Oligoribonucleotide," *Nature* 328:596-600 (1987).

Usman and Cedergren, "Exploiting the chemical synthesis of RNA," *TIBS* 17:334-339 (1992).

Usman and McSwiggen, "Ch. 30 —Catalytic RNA (Ribozymes) as Drugs," *Annual Reports in Medicinal Chemistry* 30:285-294 (1995).

Usman et al., "Automated Chemical Synthesis of Long Oligoribonucleotides Using 2'-O-Silylated Ribonucleoside 3'-O-Phosphoramidites on a Controlled-Pore Glass Support: Synthesis of a 43Nucleotide Sequence Similar to the 3'-Half Molecule of an *Escherichia coli* Formylmethoionine tRNA," *J. Am. Chem. Soc.* 109:7845-7854 (1987).
Usman et al., "Chemical modification of hammerhead ribozymes: activity and nuclease resistance," *Nucleic Acids Symposium Series* 31:163-164 (1994).
Usman et al., "Hammerhead ribozymes engineering," *Current Opinion in Structural Biology* 1:527-533 (1996).
Vaish et al., "Isolation of Hammerhead Ribozymes with Altered Core Sequences by in Vitro Selection," *Biochemistry* 36:6495-6501 (1997).
van de Stolpe et al., "12-O-Tetradecanoylphorbol- 13-acetate- and Tumor Necrosis Factor α-meidated Induction of Intercellular Adhesion Molecule-1 Is Inhibited by Dexamethasone," *J. Biol. Chem.* 269:6185-6192 (1994).
Ventura et al., "Activation of HIV-Specific Ribozyme Activity by Self-Cleavage," *Nucleic Acids Research* 21:3249-3255 (1993).
Verma and Eckstein, "Modified Oligonucleotides: Synthesis and Strategy for Users," *Annu Rev. Biochem.* 67:99-134 (1998).
Warashina, et al., "Extremeley High and Specific Activity of DNA Enzymes in Cells with a Philadelphia Chromosome," *Chemistry & Biology*, 6(4):237-250 (1999).
Werner and Uhlenbeck, "The effect of base mismatches in the substrate recognition helices of hammerhead ribozymes on binding and catalysis," *Nucleic Acids Research* 23:2092-2096 (1995).
Wincott et al., "Synthesis deprotection, analysis and purification of RNA and ribozymes," *Nucleic Acids Research* 23(14):2677-2684 (1995).
Wincott et al., "A Practical Method for the Production of RNA and Ribozymes," *Methods in Molecular Biology* 74: 59-69 (1997).
Woolf et al., "Specificity of Antisense Oligonucleotides in vivo," *Proc. Natl. Acad. Sci. USA* 89:7305-7309 (1992).
Yu et al., "A Hairpin Ribozyme Inhibits Expression of Diverse Strains of Human Immunodeficiency Virus Type 1," *Proc. Natl. Acad. Sci. USA* 90:6340-6344 (1993).
Yuan et al., "Targeted cleavage of mRNA by human RNase P," *Proc. Natl. Acad. Sci. USA* 89:8006-8010 (1992).
Zarrinkar and Williamson, "The P9.1-P9.2 peripheral extension helps guide folding of the *Tetrahymena* ribozyme," *Nucleic Acids Research* 24:854-858 (1996).
Zaug et al., "The *Tetrahymena* Ribozyme Acts Like an RNA Restriction Endonuclease," *Nature* 324:429-433 (1986).
Zhou et al., "Synthesis of Functional mRNA in Mammalian Cells by Bacteriophage T3 RNA Polymerase," *Mol. Cell. Biol.* 10:4529-4537 (1990).
Zimmerly et al., "A Group II Itron RNA is a Catalytic Component of a DNA Endonuclease Involved in Intron Mobility," *Cell* 83:529-538 (1995).
Amitabha et al., "RNA-Dependent Protein Kinase PKR Is Required for Activation of NF-$^K$B by IFN-$^\gamma$ in a STAT 1 Independent Pathway," *I Immunol* 166:6170-6180 (2001).
Fournier et al., "Identification of a receptor mediating Nogo-66 inhibition of axonal regeneration", Nature, 409:341-346 (2001).
Ho and Hartig, "Antisense oligonucleotides for large validation in the CNS," *Current Opinion in Molecular Therapeutics*, 1:336-343 (1999).
International Search Report from PCT/US02/10512.
Ishii et al., "Activation of the I$^{78}$ B$_\alpha$Kinase (IKK) complex by double-stranded RNA-binding defective and catalytic inactive mutants of the interferon-inducible protein kinase PKR," Oncogene, 20, 1900-1912 (2001).
Ng et al.,"Nogos and the Nogo-66 Receptor: Factors Inhibiting CNS Neuron Regeneration," *Journ. of Neurosicence Research* 67:559-565 (2002).
Sun et al., "Catalytic Nucleic Acids: From Lab to Applications," *Pharmacological Reviews* 52:325-347 (2000).
Woolf et al., "It Takes More Than Two to Nogo," Science 297:1132-1134 (2002).
Anderson et al., "Bispecific Short Hairpin siRNA Constructs Targeted to CD4, CXCR4, and CCR5 Confer HIV-1 Resistance," *Oligonucleotides*, 13:303-312 (2003).
Bahramian et al., "Transcriptional and Posttranscriptional Silencing of Rodent α1 (l) Collagen by a Homologous Transcriptionally Self-Silenced Transgene," Molecular and Cellular Biology, 274-283 (1999).
Elbashir et al., "Functional-Anatomy of siRNAs for Mediating Efficient RNAi in *Drosophila Melanogaster* Embryo Lysate," *The EMBO Journal* 20:6877-6888 (2001).
Elbashir et al., "RNA Interference is Mediated by 21- and 22-Nucleotide RNAs," *Genes and Development* 15:188-200 (2001).
Fire et al., "Potent and Specific Genetic Interference by Double-Stranded RNA in *Caenorhabditis Elegans,"  Nature* 391:806-811 (1998).
Fire et al., "Potent and Specific Genetic Interference by Double-Stranded RNA in Caenorhabditis Elegans," Nature 391:806-811 (1998).
Futami et al., "Induction of apoptosis in HeLa cells with siRNA expression vector targeted against bcl-2," Nucleic Acids Research Supplement, 251-252 (2002).
Hamilton, et al., "A Species of Small Antisense RNA in Posttranscriptional Gene Silencing in Plants," Science, 286, 950-952 (1999).
International Search Report for PCT/US03/05028 mailed Oct. 17, 2003.
International Search Report for PCT/US03/05346 mailed Oct. 17, 2003.
International Search Report for PCT/US2004/016390 mailed Mar. 31, 2005.
Leirdal et al., "Gene silencing in mammalian cells by preformed small RNA duplexes," Biochemical and Biophysical Research Communications, 295, 744-748 (2002).
Lin et al., "A Novel mRNA-cRNA Interference Phenomenon for Silencing bcl-2 Expression in Human LNCaP Cells," Biochemical and Biophysical Research Communications, 281, 639-644 (2001).
Lin et al., "Policing rogue genes," Nature, 402, 128-129 (1999).
Parrish, "Functional Anatomy of a dsRNA Trigger: Differential Requirement for the Two Trigger Strands in RNA Interference," *Molecular Cell* 6:1077-1087 (2000).
Partial European Search Report for EP 02 76 3926 dated Jan. 12, 2005.
Sharp et al., "RNAi and double-strand RNA," Genes & Development, 13:139-141 (1999).
Strauss, Evelyn, "Molecular Biology Candidate 'Gene Sliencers' Found," Science vol. 286, No. 5441, p. 886 (1999).
Tuschl et al., "Small Interfering RNAs: A Revolutionary Tool for Analysis of Gene Function and Gene Therapy," Molecular Interventions, 295, 3, 158-167 (2002).

Tuschl et al., "Targeted mRNA Degradation by Double-Stranded RNA In Vitro," *Genes & Development* 13:3191-3197 (1999).

Tuschl, "RNA Interference and Small Interefering RNAs," *Chembiochem* 2:239-245 (2001).

Waterhouse et al., "Virus resistance and gene silencing in plants can be induced by simultaneous expression of sense and antisense RNA, " Proc. Natl. Acad. Sci. USA, 95, 13959-13964 (1998).

L'Huillier, "Efficacy of Hammerhead Ribozymes Targeting α-Lactalbumin Transcripts: Experiments in Cells and Transgenic Mice, " *Nucleic Acids and Molecular Biology*, vol. 10, 283-300, 1996.

Player and Torrence, "The 2-5A System: Modulation of Viral and Cellular Processes Through Acceleration of RNA Degradation, " *Pharmacol Ther.* 78:55-113 (1998).

Weerasinghe et al., "Resistance to Human Immunodeficiency Virus Type 1 (HIV-1) Infection in Human $CD4^+$ Lymphocyte-Derived Cell Lines Conferred by Using Retroviral Vectors Expressing an HIV-1 RNA-Specific Ribozyme," *Journal of Virology* 65:5531-5534 (1994).

* cited by examiner

Figure 1: Examples of Nuclease Stable Ribozyme Motifs

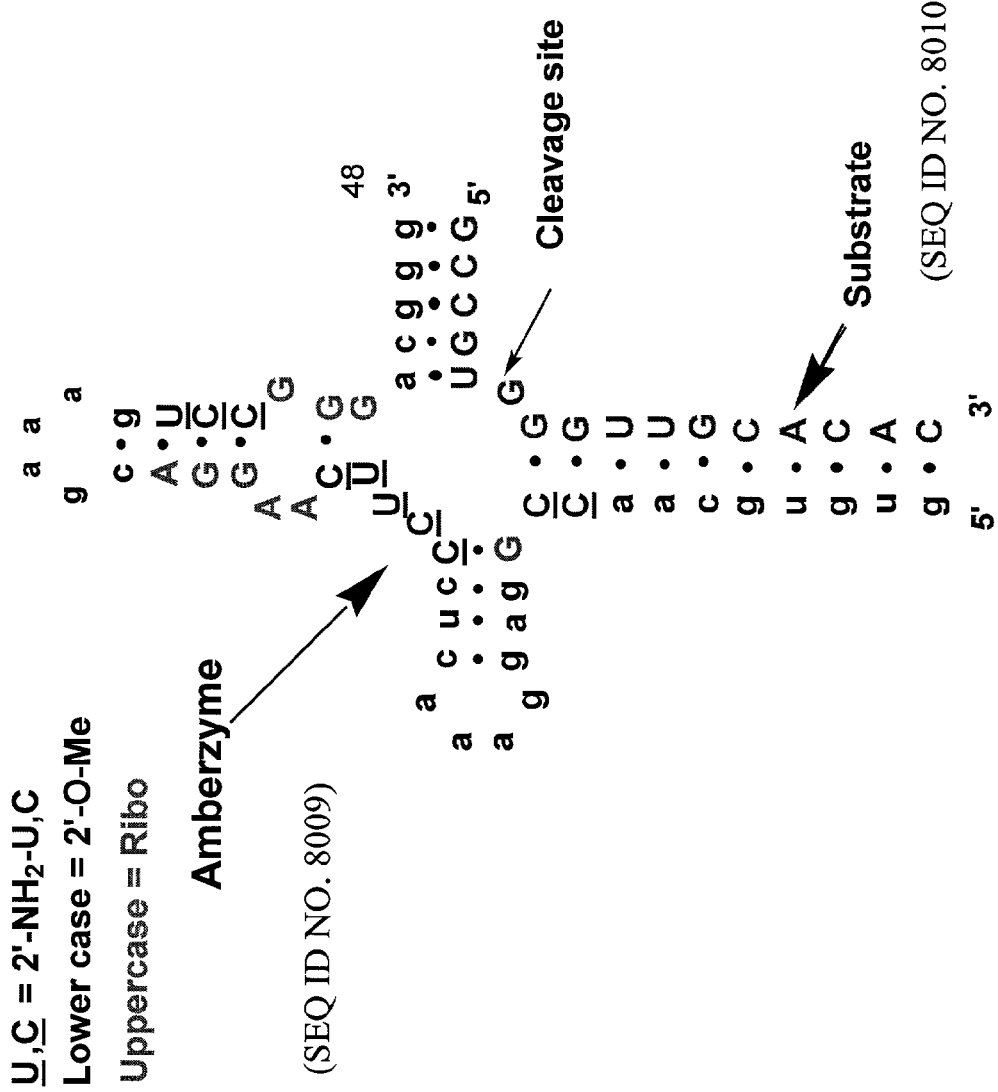

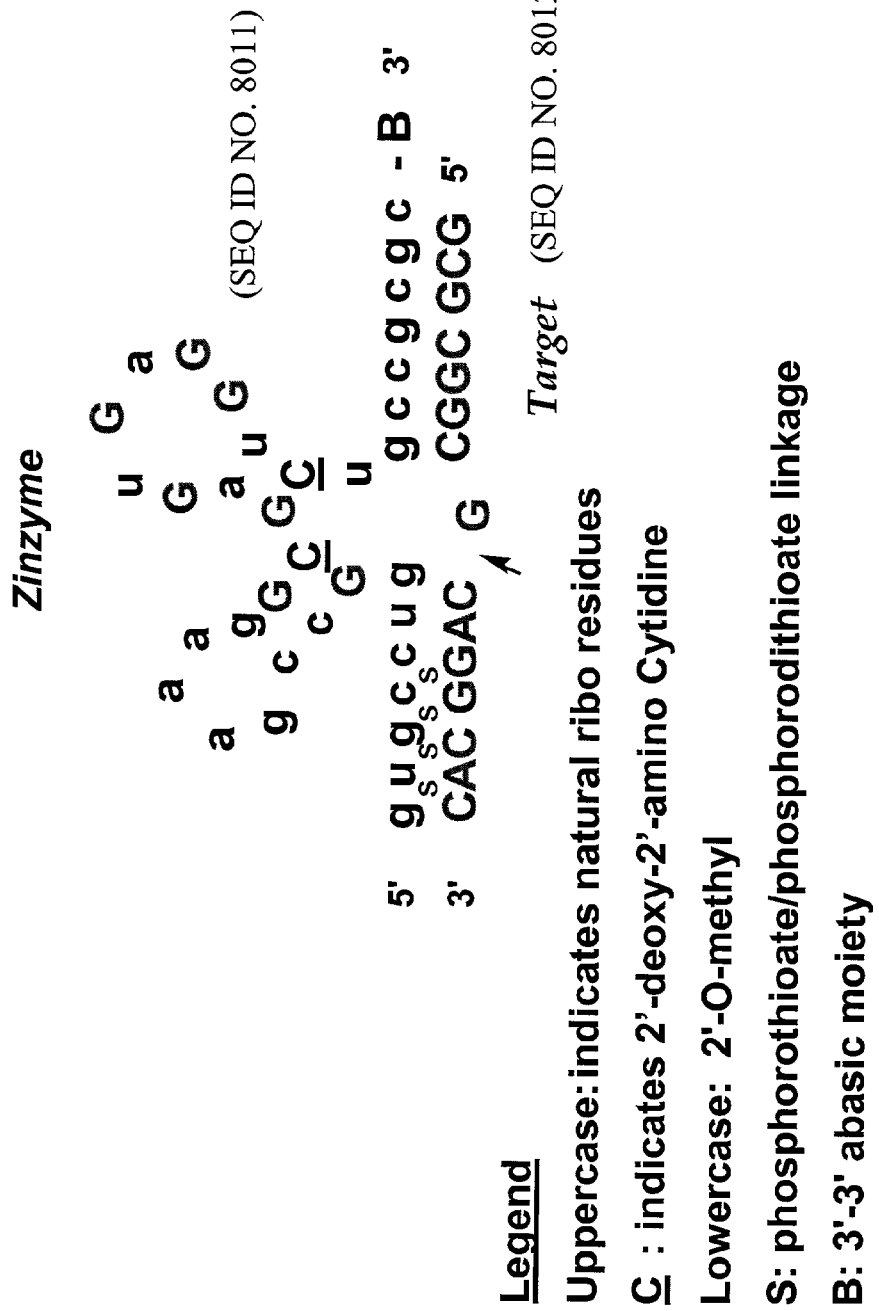
Figure 3: Stabilized Zinzyme Ribozyme Motif

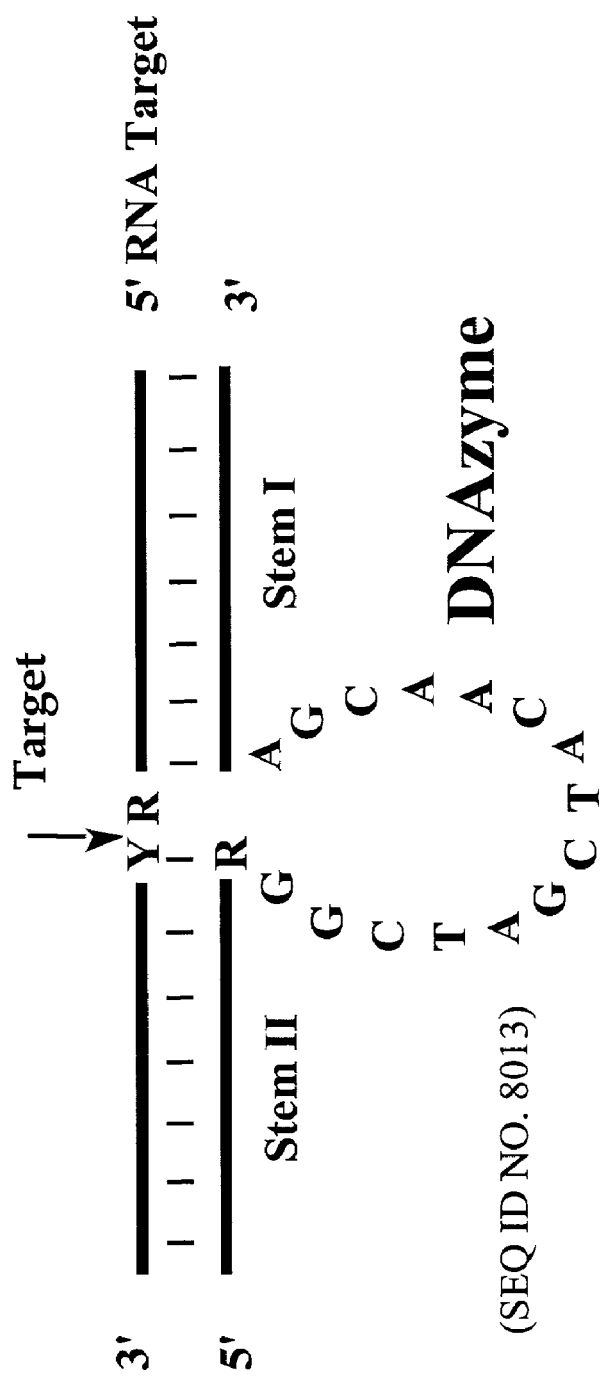
*Figure 4: DNAzyme Motif*
(SEQ ID NO. 8013)
Legend
Y = U or C
R = A or G

SIRNA TREATMENT OF DISEASES OR CONDITIONS RELATED TO LEVELS OF IKK-GAMMA

This patent application claims priority from U.S. Ser. No. 60/294,412, filed May 29, 2001, entitled 'ENZYMATIC NUCLEIC ACID TREATMENT OF DISEASES OR CONDITIONS RELATED TO LEVELS OF IKK-GAMMA AND PKR." This application is hereby incorporated by reference herein in its entirety including the drawings.

INCORPORATION BY REFERENCE

The sequence listing submitted on compact discs, in compliance with 37 C. F. R. § 1.52(e)(5), is incorporated by reference. Two separate compact discs have been submitted, each containing the file "01-664-A_Seq.Listing"which is 1,821,582 bytes in size and was created on May 16, 2005.

FIELD OF THE INVENTION

The present invention relates to therapeutic compositions and methods for the treatment or diagnosis of diseases or conditions related to IKK gamma (IKKG) and PKR levels, such as cancer, inflammatory, and autoimmune diseases and/or disorders.

BACKGROUND OF THE INVENTION

The following is a brief description of the physiological role of nuclear factor kappa B (NFKB), IKK kinases, and protein kinase PKR. The discussion is provided only for understanding the invention that follows. This summary is not an admission that any of the work described below is prior art to the claimed invention.

Nuclear factor kappa B (NFKB) is a multiunit transcription factor which regulates the expression of genes involved in a number of physiologic and pathologic processes. NFKB is a key component of the TNF signaling pathway. These processes include, but are not limited to: apoptosis, immune, inflammatory and acute phase responses. The REL-A gene product (a.k.a. RelA or p65), and p50 subunits of NFKB, have been implicated in the induction of inflammatory responses and cellular transformation. NFKB exists in the cytoplasm as an inactive heterodimer of the p50 and p65 subunits. NFKB is complexed with an inhibitory protein complex, IkappaB (IKK complex), until activated by the appropriate stimuli. NFKB activation can occur following stimulation of a variety of cell types by inflammatory mediators, for example TNF and IL-1, and reactive oxygen intermediates. In response to induction, NFKB can stimulate production of pro-inflammatory cytokines such as TNF-alpha, IL-1-beta, IL-6 and iNOS, thereby perpetuating a positive feedback loop. NFKB appears to play a role in a number of disease processes including: ischemia/reperfusion injury (CNS and myocardial), glomerulonephritis, sepsis, allergic airway inflammation, inflammatory bowel disease, infection, arthritis, and cancer.

The nuclear DNA-binding protein, NFKB, was first identified as a factor that binds and activates the immunoglobulin kappa light chain enhancer in B cells. NFKB now is known to activate transcription of a variety of other cellular genes (e.g., cytokines, adhesion proteins, oncogenes and viral proteins) in response to a variety of stimuli (e.g., phorbol esters, mitogens, cytokines and oxidative stress). In addition, molecular and biochemical characterization of NFKB has shown that the activity is due to a homodimer or heterodimer of a family of DNA binding subunits. Each subunit bears a stretch of 300 amino acids that is homologous to the oncogene, v-rel. The activity first described as NFKB is a heterodimer of p49 or p50 with p65. The p49 and p50 subunits of NFKB (encoded by the NF-kappa B2 or NF kappa B1 genes, respectively) are generated from the precursors NFKB1 (p105) or NFKB2 (p100). The p65 subunit of NFKB (now termed REL-A) is encoded by the rel-A locus.

The roles of each specific transcription-activating complex now are being elucidated in cells (Perkins, et al., 1992, *Proc. Natl. Acad. Sci USA*, 89, 1529–1533). For instance, the heterodimer of NFKB1 and Rel A (p50/p65) activates transcription of the promoter for the adhesion molecule, VCAM-1, while NFKB2/RelA heterodimers (p49/p65) actually inhibit transcription (Shu, et al, 1993, *Mol. Cell. Biol.*, 13, 6283–6289). Conversely, heterodimers of NFKB2/RelA (p49/p65) act with Tat-I to activate transcription of the HIV genome, while NFKB1/RelA (p50/p65) heterodimers have little effect (Liu et al., 1992, *J. Virol.*, 66, 3883–3887). Similarly, blocking rel A gene expression with antisense oligonucleotides specifically blocks embryonic stem cell adhesion; blocking NFKB 1 gene expression with antisense oligonucleotides had no effect on cellular adhesion (Narayanan et al., 1993, *Mol. Cell. Biol.*, 13, 3802–3810). Thus, the promiscuous role initially assigned to NFKB in transcriptional activation (Lenardo, and Baltimore, 1989, *Cell*, 58, 227–229) represents the sum of the activities of the rel family of DNA-binding proteins. This conclusion is supported by recent transgenic "knock-out" mice of individual members of the rel family. Such "knock-outs" show few developmental defects, suggesting that essential transcriptional activation functions can be performed by more than one member of the rel family.

A number of specific inhibitors of NFKB function in cells exist, including treatment with phosphorothioate antisense oliogonucleotide, treatment with double-stranded NFKB binding sites, and over expression of the natural inhibitor MAD-3 (an Ikappa-B family member). These agents have been used to show that NFKB is required for induction of a number of molecules involved in cancer and/or inflammation, as described below.

NFKB is required for phorbol ester-mediated induction of IL-6 (Kitajima, et al., 1992, *Science*, 258, 1792–5) and IL-8 (Kunsch and Rosen, 1993, *Mol. Cell. Biol.*, 13, 6137–46).

NFk is required for induction of the adhesion molecules ICAM-1 (Eck, et al., 1993, *Mol. Cell. Biol.*, 13, 6530–6536), VCAM-1 (Shu et al., supra), and E-selectin (Read, et al., 1994, *J. Exp. Med.*, 179, 503–512) on endothelial cells.

NFKB is involved in the induction of the integrin subunit, CD18, and other adhesive properties of leukocytes (Eck et al., 1993 supra).

HER2/Neu overexpression induces NFKB via a PI3-kinase/Akt pathway involving calpain-mediated degradation of IkB-alpha. Breast cancer has been shown to typify the aberrant expression of NFKB/REL factors (Pianetti et al., 2001, *Oncogene*, 20, 1287–1299; Sovak et al., 1999, *J. Clin. Invest.*, 100, 2952–2960).

Inhibition of NFKB activity has been shown to induce apoptosis in murine hepatocytes (Bellas et al., 1997, *Am. J. Pathol.*, 151,891–896).

NFKB has been shown to regulate cyclooxygenase-2 expression and cell proliferation in human gastric cancer cells (Joo Weon et al., 2001, *Laboratory Investigation*, 81, 349–360).

The above studies suggest that NFKB is integrally involved in the induction of cytokines and adhesion molecules by inflammatory mediators and is involved in the transformation of cancerous cells. Two reported studies point to another connection between NFKB and inflammation: glucocorticoids can exert their anti-inflammatory effects by inhibiting NFKB. The glucocorticoid receptor and p65 both act at NFKB binding sites in the ICAM-1 promoter (van de Stolpe, et al., 1994, *J. Biol. Chem.*, 269, 6185–6192). Glucocorticoid receptor inhibits NFKB-mediated induction of IL-6 (Ray and Prefontaine, 1994 *Proc. Natl. Acad. Sci USA*, 91, 752–756). Conversely, overexpression of p65 inhibits glucocorticoid induction of the mouse mammary tumor virus promoter. Finally, protein cross-linking and co-immunoprecipitation experiments demonstrated direct physical interaction between p65 and the glucocorticoid receptor.

The IKK complex that sequesters NFKB in the cytoplasm comprises IkappaB (IκB) proteins (IκB-alpha, IκB-beta, IκB-epsilon, p105, and p100). The phosphorylation of IκB proteins results in the release of NFKB from the IκB complex which is transported to the nucleus via the unmasking of nuclear translocation signals. Phosphorylation marks IκB proteins for ubiquitination and degradation via the proteosome pathway. Most NFKB inducing stimuli initiate activation of an IκB kinase (IKK) complex that contains two catalytic subunits, IKK-alpha (IKK1) and IKK-beta (IKK2), that phosphorylate IκB-alpha and IκB-beta, with IKK-beta playing a predominant role in pro-inflammatory signaling. In addition to the two kinases, the IKK complex contains regulatory subunits, including IKK-gamma (NEMO/IKKAP1). IKK-gamma is a protein that is critical for the assembly of the IKK complex. IKK-gamma directly binds to IKK-beta and is required for activation of NFKB, for example by TNF-alpha, IL-1-beta, lipopolysaccharide, phorbol 12-myristate 13-acetate, the human T-cell lymphotrophic virus (HTLV-1), or double stranded RNA. Genomic rearrangements in IKK-gamma have been shown to impair NFKB activation and result in incontinentia pigmenti. Additional proteins that associate with the IKK complex include, MEK kinase (MEKK1), NFKB inducing kinase (NIK), receptor interacting protein (RIP), protein kinase CK2, and IKK-associated protein (IKAP), which appears to be associated with the IκB Kinase (IKK) complex, but does not appear to be an integral component of the tripartite IKK complex as does IKK-gamma (Krappmann et al., 2001, *J. Biol. Chem.*, 275, 29779–87).

The RNA-dependent protein kinase PKR is a signal transducer for NFKB and IFN regulatory factor-1. PKR is required for activation of NFKB by IFN-gamma via a STAT-1 independent pathway (Amitabha et al., 2001, *J. Immunol.*, 166, 6170–6180). The induction of NFKB by PKR takes place though phosphorylation of IκB-alpha, and appears not to require the catalytic activity of PKR, thereby proceeding independently of the dsRNA-binding properties of PKR (Ishii et al., 2001, *Oncogene*, 20, 1900–1912). PKR also plays an important role in the regulation of protein synthesis by modulating the activity of eukaryotic initiation factor 2 (eIF-2-alpha) through interferon induction.

Kamiya, JP 2000253884, describes specific antisense oligonucleotides for inhibiting IκB-kinase subunit expression. Krappmann et al, 2001, *J. Biol. Chem.*, describe specific antisense oligonucleotides to IKK-gamma.

SUMMARY OF THE INVENTION

The present invention features a nucleic acid molecule, such as decoy RNA, dsRNA, siRNA, aptamers, antisense nucleic acid molecules, and enzymatic nucleic acid molecule which down regulates expression of a sequence encoding an IkappaB kinase (IKK) subunit. The invention also features an enzymatic nucleic acid molecule which down regulates expression of a sequence encoding protein kinase PKR.

In one embodiment, an enzymatic nucleic acid molecule of the invention comprises a sequence selected from the group consisting of SEQ ID NOs. 632–1261, 1762–2260, 2480–2698, 2904–3485, 3814–4360, 4555–4748, 5253–5756, 6034–6310, 6380–6789, 7142–7770, and 7884–8001.

In another embodiment, an enzymatic nucleic acid molecule of the invention comprises at least one binding arm wherein one or more of said binding arms comprises a sequence complementary to a sequence selected from the group consisting of SEQ ID NOs. 1–631, 1263–1761, 2261–2479, 2699–2903, 3486–3813, 4361–4554, 4749–5252, 5757–6033, 6311–6379, 6790–7141 and 7771–7883.

In another embodiment, an antisense nucleic acid molecule of the invention comprises a sequence complementary to a sequence selected from the group consisting of SEQ ID NOs. 1–631, 1263–1761, 2261–2479, 2699–2903, 3486–3813, 4361–4554, 4749–5252, 5757–6033, 6311–6379, 6790–7141, and 7771–7883.

In another embodiment, a nucleic acid molecule of the invention is adapted to treat cancer. In yet another embodiment, an enzymatic nucleic acid molecule of the invention has an endonuclease activity to cleave RNA having IKK-gamma or PKR nucleic acid sequence.

In one embodiment, an enzymatic nucleic acid molecule of the invention is in an Inozyme, Zinzyme, G-cleaver, Amberzyme, DNAzyme, or Hammerhead configuration.

In another embodiment, an Inozyme of the invention comprises a sequence complementary to a sequence selected from the group consisting of SEQ ID NOs. 1263–1761, 4749–5252, 7781–7787, 7796–7800, 7822–7846, and 7866–7870.

In another embodiment, an Inozyme of the invention comprises a sequence selected from the group consisting of SEQ ID NOs. 1762–2260, 5253–5756, 7894–7900, 7909–7913, 7938–7962, and 7982–7986.

In another embodiment, a Zinzyme of the invention comprises a sequence complementary to a sequence selected from the group consisting of SEQ ID NOs. 2261–2479, 5757–6033, 7788–7790, 7847–7860, and 7871–7895.

In another embodiment, a Zinzyme of the invention comprises a sequence selected from the group consisting of SEQ ID NOs 2480–2698, 6034–6310, 7901–7903, 7963–7976, and 7987–7991.

In another embodiment, an Amberzyme of the invention comprises a sequence selected from the group consisting of SEQ ID NOs 3814–4360, 7142–7770, 7924–7928, and 7997–8001.

In another embodiment, a DNAzyme of the invention comprises a sequence selected from the group consisting of SEQ ID NOs 2904–3485, 6380–6789, 7919–7923, and 7992–7996.

In another embodiment, a Hammerhead of the invention comprises a sequence complementary to a sequence selected from the group consisting of SEQ ID NOs. 1–631, 4361–4554, 7771–7780, 7791–7795, 7813–7821, and 7861–7865.

In another embodiment, a Hammerhead of the invention comprises a sequence selected from the group consisting of SEQ ID NOs 632–1262, 4555–4748, 7884–7894, 7904–7908, 7929–7937, 7977–7981.

In one embodiment, a nucleic acid molecule of the invention comprises between 12 and 100 bases complementary to RNA having an IKK-gamma or PKR nucleic acid sequence. In another embodiment, a nucleic acid molecule of the invention comprises between 14 and 24 bases complementary to RNA having anIKK-gamma or PKR nucleic acid sequence.

In yet another embodiment, a nucleic acid molecule of the invention is chemically synthesized.

In another embodiment, a nucleic acid molecule or antisense nucleic acid molecule of the invention comprises at least one 2'-sugar modification, at least one nucleic acid base modification, or at least one phosphate backbone modification.

In one embodiment, a siRNA molecule of the invention comprises a double stranded RNA wherein one strand of the RNA is complimentary to the RNA of IKK-gamma or PKR gene. In another embodiment, a siRNA molecule of the invention comprises a double stranded RNA wherein one strand of the RNA comprises a portion of a sequence of RNA having IKK-gamma or PKR gene sequence. In yet another embodiment, a siRNA molecule of the invention comprises a double stranded RNA wherein both strands of RNA are connected by a non-nucleotide linker. Alternately, a siRNA molecule of the invention comprises a double stranded RNA wherein both strands of RNA are connected by a nucleotide linker, such as a loop or stem loop structure.

In one embodiment, a single strand component of a siRNA molecule of the invention is from about 14 to about 50 nucleotides in length. In another embodiment, a single strand component of a siRNA molecule of the invention is about 14, 15, 16, 17, 18, 19, 20, 21, 22, 23, 24, 25, 26, 27, or 28 nucleotides in length. In yet another embodiment, a single strand component of a siRNA molecule of the invention is about 23 nucleotides in length. In one embodiment, a siRNA molecule of the invention is from about 28 to about 56 nucleotides in length. In another embodiment, a siRNA molecule of the invention is about 40, 41, 42, 43, 44, 45, 46, 47, 48, 49, 50, 51, or 52 nucleotides in length. In yet another embodiment, a siRNA molecule of the invention is about 46 nucleotides in length.

In another embodiment, an enzymatic nucleic acid molecule, antisense nucleic acid molecule, decoy RNA, dsRNA, siRNA, or aptamer molecules of the invention comprises at least one 2'-sugar modification.

In another embodiment, an enzymatic nucleic acid molecule, antisense nucleic acid molecule, decoy RNA, dsRNA, siRNA, or aptamer, nucleic acids of the invention comprises at least one nucleic acid base modification.

In another embodiment, an enzymatic nucleic acid molecule, antisense nucleic acid molecule, decoy RNA, dsRNA, siRNA, or aptamer, nucleic acids of the invention comprises at least one phosphate backbone modification.

In one embodiment, the invention features a mammalian cell, for example a human cell, including an nucleic acid molecule of the invention.

The present invention features method of down-regulating PKR activity in a cell, comprising contacting the cell with an enzymatic nucleic acid molecule or antisense nucleic acid molecule, or other nucleic acid molecule of the invention, under conditions suitable for down-regulating of PKR activity.

The present invention also features method of treatment of a subject having a condition associated with the level of PKR, comprising contacting cells of the subject with an enzymatic nucleic acid molecule or antisense nucleic acid molecule or other nucleic acid molecule of the invention under conditions suitable for the treatment.

The present invention features method of down-regulating IKK-gamma activity in a cell, comprising contacting the cell with an enzymatic nucleic acid molecule or antisense nucleic acid molecule or other nucleic acid molecule of the invention, under conditions suitable for down-regulating of IKK-gamma activity.

The present invention also features method of treatment of a subject having a condition associated with the level of IKK-gamma, comprising contacting cells of the subject with the enzymatic nucleic acid molecule or antisense nucleic acid molecule or other nucleic acid molecule of the invention, under conditions suitable for the treatment.

In one embodiment, a method of treatment of the invention comprises the use of one or more drug therapies under conditions suitable for said treatment.

The present invention features methods of cleaving RNA comprising a PKR nucleic acid sequence comprising contacting an enzymatic nucleic acid molecule of the invention with the RNA under conditions suitable for the cleavage.

The present invention also features methods of cleaving RNA comprising a IKK-gamma nucleic acid sequence comprising contacting an enzymatic nucleic acid molecule of the invention with the RNA under conditions suitable for the cleavage.

In one embodiment, a method of cleavage of the invention is carried out in the presence of a divalent cation, for example Mg2+.

In another embodiment, an enzymatic nucleic acid or antisense nucleic acid molecule or other nucleic acid molecule of the invention comprises a cap structure, wherein the cap structure is at the 5'-end, or 3'-end, or both the 5'-end and the 3'-end, for example a 3', 3'-linked or 5', 5'-linked deoxyabasic derivative.

The present invention also features an expression vector comprising a nucleic acid sequence encoding at least one enzymatic nucleic acid molecule, antisense, or other nucleic acid molecule of the invention in a manner which allows expression of the nucleic acid molecule.

In one embodiment, the invention features a mammalian cell, for example a human cell, including an expression vector contemplated by the invention.

In another embodiment, an expression vector of the invention further comprises an antisense nucleic acid molecule complementary to RNA of a subunit of IKK-gamma or PKR.

In yet another embodiment, an expression vector of the invention comprises a nucleic acid sequence encoding two or more enzymatic nucleic acid molecules, which can be the same or different.

The present invention also features a method for treatment of cancer, for example breast cancer, lung cancer, prostate cancer, colorectal cancer, brain cancer, esophageal cancer, stomach cancer, bladder cancer, pancreatic cancer, cervical cancer, head and neck cancer, ovarian cancer, melanoma, lymphoma, glioma, or multidrug resistant cancer, comprising administering to a subject an enzymatic nucleic acid molecule or antisense nucleic acid molecule or other nucleic acid molecule of the invention under conditions suitable for said treatment.

In one embodiment, a nucleic acid molecule of the invention comprises at least five ribose residues, at least ten 2'-O-methyl modifications, and a 3'- end modification such as a 3'-3' inverted abasic moiety, and/or phosphorothioate linkages on at least three of the 5' terminal nucleotides.

In another embodiment, other drug therapies contemplated by the invention include monoclonal antibodies, IKI-gamma or PKR-specific inhibitors, chemotherapy, or radiation therapy.

Specific chemotherapy contemplated by the invention include paclitaxel, docetaxel, cisplatin, methotrexate, cyclophosphamide, 5-fluoro uridine, Leucovorin, Irinotecan (CAMPTOSAR® or CPT-11 or Camptothecin-11 or Campto), Paclitaxel, Carboplatin doxorubin, fluorouracil carboplatin, edatrexate, gemcitabine, or vinorelbine or a combination thereof.

The invention also features a method for treatment of an inflammatory disease, for example rheumatoid arthritis, restenosis, asthma, Crohn's disease, diabetes, obesity, autoimmune disease, lupus, multiple sclerosis, transplant/graft rejection, gene therapy applications, ischemia/reperfusion injury, glomerulonephritis, sepsis, allergic airway inflammation, inflammatory bowel disease, or infection, comprising the step of administering to a subject an enzymatic nucleic acid or antisense nucleic acid molecule of the invention under conditions suitable for the treatment.

The present invention features compositions comprising the enzymatic nucleic acid and/or antisense nucleic acid molecules of the invention in a pharmaceutically acceptable carrier.

The invention also features a method of administering to a cell, such as mammalian cell (e.g. human cell), where the cell can be in culture or in a mammal, such as a human, an enzymatic nucleic acid molecule or antisense molecule of the instant invention, comprising contacting the cell with the enzymatic nucleic acid molecule or antisense molecule or other nucleic acid molecule of the invention under conditions suitable for such administration. The method of administration can be in the presence of a delivery reagent, for example a lipid, cationic lipid, phospholipid, or liposome.

DETAILED DESCRIPTION OF THE INVENTION

First the drawings will be described briefly.

DRAWINGS

FIG. 1 shows examples of chemically stabilized ribozyme motifs. HH Rz, represents hammerhead ribozyme motif (Usman et al., 1996, *Curr. Op. Struct. Bio.*, 1, 527); NCH Rz represents the NCH ribozyme motif (Ludwig & Sproat, International PCT Publication No. WO 98/58058); G-Cleaver, represents G-cleaver ribozyme motif (Kore et al., 1998, *Nucleic Acids Research* 26, 4116–4120, Eckstein et al., International PCT publication No. WO 99/16871). N or n, represent independently a nucleotide which can be same or different and have complementarity to each other; rI, represents ribo-Inosine nucleotide; arrow indicates the site of cleavage within the target. Position 4 of the HH Rz and the NCH Rz is shown as having 2'-C-allyl modification, but those skilled in the art will recognize that this position can be modified with other modifications well known in the art, so long as such modifications do not significantly inhibit the activity of the ribozyme.

FIG. 2 shows an example of the Amberzyme ribozyme motif that is chemically stabilized (see for example Beigelman et al, International PCT publication No. WO 99/55857).

FIG. 3 shows an example of the Zinzyme A ribozyme motif that is chemically stabilized (see for example Beigelman et al., Beigelman et al., International PCT publication No. WO 99/55857).

FIG. 4 shows an example of a DNAzyme motif described by Santoro et al., 1997, *PNAS*, 94, 4262.

The invention features nucleic acid molecules, for example enzymatic nucleic acid molecules, antisense nucleic acid molecules, 2,5-A chimeras, decoys, double stranded RNA, triplex oligonucleotides, and/or aptamers, and methods to modulate gene expression, for example, genes encoding a member of the IκB kinase IKK complex, such as IKK-alpha (IKK1), IKK-beta (IKK2), or IKK-gamma (IKKγ) and/or a protein kinase PKR protein. In particular, the instant invention features nucleic-acid based molecules and methods to modulate the expression of IKK-gamma (IKKγ) and protein kinase PKR.

The invention features one or more enzymatic nucleic acid-based molecules and methods that independently or in combination modulate the expression of gene(s) encoding a member of the IκB kinase IKK complex or PKR. In particular embodiments, the invention features nucleic acid-based molecules and methods that modulate the expression of a member of the IκB kinase IKK complex, for example IKK-alpha (IKK1), IKK-beta (IKK2), or IKK-gamma (IKKγ) and/or a protein kinase PKR protein, such as IKK-alpha (IKK1) gene (Genbank Accession No. NM_001278); IKK-beta (IKK2) gene, for example (Genbank Accession No. AF080158), IKK-ganima (IKKγ) gene, for example (Genbank Accession No. NM_003639) (SEQ ID NO:8014), and protein kinase PKR gene, for example (Genbank Accession No. NM_002759).

The description below of the various aspects and embodiments is provided with reference to the exemplary IKK-gamma and PKR genes. IKK-gamma is also known as NEMO/IKKAP1. However, the various aspects and embodiments are also directed to other genes which encode other subunits of the IKK complex, such as IKK-alpha (IKK1) or IKK-beta (IKK2). Those additional genes can be analyzed for target sites using the methods described for IKK-gamma or PKR. Thus, the inhibition and the effects of such inhibition of the other genes can be performed as described herein.

In one embodiment, the invention features the use of an enzymatic nucleic acid molecule, preferably in the hammerhead, NCH, G-cleaver, amberzyme, zinzyme and/or DNAzyme motif, to down-regulate the expression of IKK-gamma or PKR genes.

By "inhibit" or "down-regulate" it is meant that the expression of the gene, or level of RNAs or equivalent RNAs encoding one or more protein subunits, or activity of one or more protein subunits, such as IKK-gamma or PKR subunit(s), is reduced below that observed in the absence of the nucleic acid molecules of the invention. In one embodiment, inhibition or down-regulation with enzymatic nucleic acid molecule preferably is below that level observed in the presence of an enzymatically inactive or attenuated molecule that is able to bind to the same site on the target RNA, but is unable to cleave that RNA. In another embodiment, inhibition or down-regulation with antisense oligonucleotides is preferably below that level observed in the presence of, for example, an oligonucleotide with scrambled sequence or with mismatches. In another embodiment, inhibition or down-regulation of IKK-gamma or PKR with the nucleic acid molecule of the instant invention is greater in the presence of the nucleic acid molecule than in its absence.

By "up-regulate" is meant that the expression of the gene, or level of RNAs or equivalent RNAs encoding one or more protein subunits, or activity of one or more protein subunits, such as IKK-gamma or PKR subunit(s), is greater than that observed in the absence of the nucleic acid molecules of the invention. For example, the expression of a gene, such as IKK-gamma or PKR gene, can be increased in order to treat, prevent, ameliorate, or modulate a pathological condition caused or exacerbated by an absence or low level of gene expression.

By "modulate" is meant that the expression of the gene, or level of RNAs or equivalent RNAs encoding one or more protein subunits, or activity of one or more protein subunit(s) is up-regulated or down-regulated, such that the expression, level, or activity is greater than or less than that observed in the absence of the nucleic acid molecules of the invention.

By "enzymatic nucleic acid molecule" it is meant a nucleic acid molecule which has complementarity in a substrate binding region to a specified gene target, and also has an enzymatic activity which is active to specifically cleave target RNA. That is, the enzymatic nucleic acid molecule is able to intermolecularly cleave RNA and thereby inactivate a target RNA molecule. These complementary regions allow sufficient hybridization of the enzymatic nucleic acid molecule to the target RNA and thus permit cleavage. One hundred percent complementarity is preferred, but complementarity as low as 50–75% can also be useful in this invention (see for example Werner and Uhlenbeck, 1995, *Nucleic Acids Research*, 23, 2092–2096; Hammann et al., 1999, *Antisense and Nucleic Acid Drug Dev.*, 9, 25–31). The nucleic acids can be modified at the base, sugar, and/or phosphate groups. The term enzymatic nucleic acid is used interchangeably with phrases such as ribozymes, catalytic RNA, enzymatic RNA, catalytic DNA, aptazyme or aptamer-binding ribozyme, regulatable ribozyme, catalytic oligonucleotides, nucleozyme, DNAzyme, RNA enzyme, endoribonuclease, endonuclease, minizyme, leadzyme, oligozyme or DNA enzyme. All of these terminologies describe nucleic acid molecules with enzymatic activity. The specific enzymatic nucleic acid molecules described in the instant application are not limiting in the invention and those skilled in the art will recognize that all that is important in an enzymatic nucleic acid molecule of this invention is that it has a specific substrate binding site which is complementary to one or more of the target nucleic acid regions, and that it have nucleotide sequences within or surrounding that substrate binding site which impart a nucleic acid cleaving and/or ligation activity to the molecule (Cech et al., U.S. Pat. No. 4,987,071; Cech et al., 1988, 260 *JAMA* 3030).

Several varieties of enzymatic RNAs are known presently. Each can catalyze the hydrolysis of RNA phosphodiester bonds in trans (and thus can cleave other RNA molecules) under physiological conditions. Table I summarizes some of the characteristics of these ribozymes. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets. Thus, a single ribozyme molecule is able to cleave many molecules of target RNA. In addition, the ribozyme is a highly specific inhibitor of gene expression, with the specificity of inhibition depending not only on the base-pairing mechanism of binding to the target RNA, but also on the mechanism of target RNA cleavage. Single mismatches, or base-substitutions, near the site of cleavage can completely eliminate catalytic activity of a ribozyme.

By "nucleic acid molecule" as used herein is meant a molecule having nucleotides. The nucleic acid can be single, double, or multiple stranded and can comprise modified or unmnodified nucleotides or non-nucleotides or various mixtures and combinations thereof.

By "enzymatic portion" or "catalytic domain" is meant that portion/region of the enzymatic nucleic acid molecule essential for cleavage of a nucleic acid substrate (for example see FIGS. 1–4).

By "substrate binding arm" or "substrate binding domain" is meant that portion/region of a enzymatic nucleic acid which is able to interact, for example via complementarity (i.e., able to base-pair with), with a portion of its substrate. Preferably, such complementarity is 100%, but can be less if desired. For example, as few as 10 bases out of 14 can be base-paired (see for example Werner and Uhlenbeck, 1995, *Nucleic Acids Research*, 23, 2092–2096; Hammann et al., 1999, *Antisense and Nucleic Acid Drug Dev.*, 9, 25–31). Examples of such arms are shown generally in FIGS. 1–4. That is, these arms contain sequences within a enzymatic nucleic acid which are intended to bring enzymatic nucleic acid and target RNA together through complementary base-pairing interactions. The enzymatic nucleic acid of the invention can have binding arms that are contiguous or non-contiguous and can be of varying lengths. The length of the binding arm(s) are preferably greater than or equal to three nucleotides and of sufficient length to stably interact with the target RNA; preferably 12–100 nucleotides; more preferably 14–24 nucleotides long (see for example Werner and Uhlenbeck, supra; Hamman et al., supra; Hampel et al., EP0360257; Berzal-Herranz et al., 1993, *EMBO J.*, 12, 2567–73). If two binding arms are chosen, the design is such that the length of the binding arms are symmetrical (i.e., each of the binding arms is of the same length; e.g., five and five nucleotides, or six and six nucleotides, or seven and seven nucleotides long) or asymmetrical (i.e., the binding arms are of different length; e.g., six and three nucleotides; three and six nucleotides long; four and five nucleotides long; four and six nucleotides long; four and seven nucleotides long; and the like).

By "Inozyme" or "NCH" motif or configuration is meant, an enzymatic nucleic acid molecule comprising a motif as is generally described as NCH Rz in FIG. 1. Inozymes possess endonuclease activity to cleave RNA substrates having a cleavage triplet NCH/, where N is a nucleotide, C is cytidine and H is adenosine, uridine or cytidine, and / represents the cleavage site. H is used interchangeably with X. Inozymes can also possess endonuclease activity to cleave RNA substrates having a cleavage triplet NCN/, where N is a nucleotide, C is cytidine, and / represents the cleavage site. "I" in FIG. 1 represents an Inosine nucleotide, preferably a ribo-Inosine or xylo-Inosine nucleoside.

By "G-cleaver" motif or configuration is meant, an enzymatic nucleic acid molecule comprising a motif as is generally described as G-cleaver Rz in FIG. 1. G-cleavers possess endonuclease activity to cleave RNA substrates having a cleavage triplet NYN/, where N is a nucleotide, Y is uridine or cytidine and / represents the cleavage site. G-cleavers can be chemically modified as is generally shown in FIG. 1.

By "amberzyme" motif or configuration is meant, an enzymatic nucleic acid molecule comprising a motif as is generally described in FIG. 2. Amberzymes possess endonuclease activity to cleave RNA substrates having a cleavage triplet NG/N, where N is a nucleotide, G is guanosine, and / represents the cleavage site. Amberzymes can be chemically modified to increase nuclease stability through substitutions as are generally shown in FIG. 2. In addition, differing nucleoside and/or non-nucleoside linkers can be used to substitute the 5'-gaaa-3' loops shown in the figure. Amberzymes represent a non-limiting example of an enzymatic nucleic acid molecule that does not require a ribonucleotide (2'-OH) group within its own nucleic acid sequence for activity.

By "zinzyme" motif or configuration is meant, an enzymatic nucleic acid molecule comprising a motif as is generally described in FIG. 3. Zinzymes possess endonuclease activity to cleave RNA substrates having a cleavage triplet including but not limited to YG/Y, where Y is uridine or cytidine, and G is guanosine and / represents the cleavage site. Zinzymes can be chemically modified to increase nuclease stability through substitutions as are generally shown in FIG. 3, including substituting 2'-O-methyl guanosine nucleotides for guanosine nucleotides. In addition, differing nucleotide and/or non-nucleotide linkers can be used to substitute the 5'-gaaa-2' loop shown in the figure. Zinzymes represent a non-limiting example of an enzymatic nucleic acid molecule that does not require a ribonucleotide (2'-OH) group within its own nucleic acid sequence for activity.

By 'DNAzyme' is meant, an enzymatic nucleic acid molecule that does not require the presence of a 2'-OH group within its own nucleic acid sequence for activity. In particular embodiments the enzymatic nucleic acid molecule can have an attached linker(s) or other attached or associated groups, moieties, or chains containing one or more nucleotides with 2'-OH groups. DNAzymes can be synthesized chemically or expressed endogenously in vivo, by means of a single stranded DNA vector or equivalent thereof. An example of a DNAzyme is shown in FIG. 4 and is generally reviewed in Usman et al., U.S. Pat. No. 6,159,714; Chartrand et al., 1995, *NAR* 23, 4092; Breaker et al., 1995, *Chem. Bio.* 2, 655; Santoro et al., 1997, *PNAS* 94, 4262; Breaker, 1999, *Nature Biotechnology*, 17, 422–423; and Santoro et. al., 2000, *J. Am. Chem. Soc.*, 122, 2433–39. Additional DNAzyme motifs can be selected for using techniques similar to those described in these references, and hence, are within the scope of the present invention.

By "sufficient length" is meant an oligonucleotide of greater than or equal to 3 nucleotides that is of a length great enough to provide the intended function under the expected condition. For example, for binding arms of enzymatic nucleic acid "sufficient length" means that the binding arm sequence is long enough to provide stable binding to a target site under the expected binding conditions. Preferably, the binding arms are not so long as to prevent useful turnover of the nucleic acid molecule.

By "stably interact" is meant interaction of the oligonucleotides with target nucleic acid (e.g., by forming hydrogen bonds with complementary nucleotides in the target under physiological conditions) that is sufficient to the intended purpose (e.g., cleavage of target RNA by an enzyme).

By "equivalent" or "related" RNA to IKK-gamma is meant to include those naturally occurring RNA molecules having homology (partial or complete) to TKK-gamma proteins or encoding for proteins with similar function as IKK-gamma proteins in various organisms, including human, rodent, primate, rabbit, pig, protozoans, flngi, plants, and other microorganisms and parasites. The equivalent RNA sequence also includes in addition to the coding region, regions such as 5'-untranslated region, 3'-untranslated region, introns, intron-exon junction and the like.

By "equivalent" or "related" RNA to PKR is meant to include those naturally occurring -RNA molecules having homology (partial or complete) to PKR proteins or encoding for proteins Awith similar function as PKR proteins in various organisms, including human, rodent, primate, rabbit, pig, protozoans, fungi, plants, and other microorganisms and parasites. The equivalent RNA sequence also includes in addition to the coding region, regions such as 5'-untranslated region, 3'-untranslated region, introns, intron-exon junction and the like.

By "homology" is meant the nucleotide sequence of two or more nucleic acid molecules is partially or completely identical.

By "antisense nucleic acid", it is meant a non-enzymatic nucleic acid molecule that binds to target RNA by means of RNA—RNA or RNA-DNA or RNA-PNA (protein nucleic acid; Egholm et al., 1993 *Nature* 365, 566) interactions and alters the activity of the target RNA (for a review, see Stein and Cheng, 1993 *Science* 261, 1004 and Woolf et al., U.S. Pat. No. 5,849,902). Typically, antisense molecules are complementary to a target sequence along a single contiguous sequence of the antisense molecule. However, in certain embodiments, an antisense molecule can bind to substrate such that the substrate molecule forms a loop, and/or an antisense molecule can bind such that the antisense molecule forms a loop. Thus, the antisense molecule can be complementary to two (or even more) non-contiguous substrate sequences or two (or even more) non-contiguous sequence portions of an antisense molecule can be complementary to a target sequence or both. For a review of current antisense strategies, see Schmajuk et al., 1999, *J. Biol. Chem.*, 274, 21783–21789, Delihas et al., 1997, *Nature*, 15, 751–753, Stein et al., 1997, *Antisense N. A. Drug Dev.*, 7, 151, Crooke, 2000, *Methods Enzymol.*, 313, 3–45; Crooke, 1998, *Biotech. Genet. Eng. Rev.*, 15, 121–157, Crooke, 1997, *Ad. Pharmacol*, 40, 1–49. In addition, antisense DNA can be used to target RNA by means of DNA-RNA interactions, thereby activating RNase H, which digests the target RNA in the duplex. The antisense oligonucleotides can comprise one or more RNAse H activating region, which is capable of activating RNAse H cleavage of a target RNA. Antisense DNA can be synthesized chemically or expressed via the use of a single stranded DNA expression vector or equivalent thereof.

By "RNase H activating region" is meant a region (generally greater than or equal to 4–25 nucleotides in length, preferably from 5–11 nucleotides in length) of a nucleic acid molecule capable of binding to a target RNA to form a non-covalent complex that is recognized by cellular RNase H enzyme (see for example Arrow et al., U.S. Pat. No. 5,849,902; Arrow et al., U.S. Pat. No. 5,989,912). The RNase H enzyme binds to the nucleic acid molecule-target RNA complex and cleaves the target RNA sequence. The RNase H activating region comprises, for example, phosphodiester, phosphorothioate (preferably at least four of the nucleotides are phosphorothiote substitutions; more specifically, 4–11 of the nucleotides are phosphorothiote substitutions); phosphorodithioate, 5'-thiophosphate, or methylphosphonate backbone chemistry or a combination thereof. In addition to one or more backbone chemistries described above, the RNase H activating region can also comprise a variety of sugar chemistries. For example, the RNase H activating region can comprise deoxyribose, arabino, fluoroarabino or a combination thereof, nucleotide sugar chemistry. Those skilled in the art will recognize that the foregoing are non-limiting examples and that any combination of phosphate, sugar and base chemistry of a nucleic acid that supports the activity of RNase H enzyme is within the scope of the definition of the RNase H activating region and the instant invention.

By "2–5A chimera" is meant an oligonucleotide, for example an antisense nucleic acid molecule or enzymatic nucleic acid molecule, containing a 5'-phosphorylated 2'-5'-linked adenylate residue. These chimeras bind to target RNA in a sequence-specific manner and activate a cellular 2–5A-dependent ribonuclease which, in turn, cleaves the target RNA (Torrence et al., 1993 *Proc. Natl. Acad. Sci. USA* 90, 1300; Silverman et al., 2000, *Methods Enzymol.*, 313, 522–533; Player and Torrence, 1998, *Pharmacol. Ther.*, 78, 55–113).

By "triplex forming oligonucleotides" or "triplex oligonucleotide" is meant an oligonucleotide that can bind to a double-stranded DNA in a sequence-specific manner to form a triple-strand helix. Formation of such triple helix structure has been shown to inhibit transcription of the targeted gene (Duval-Valentin et al., 1992 *Proc. Natl. Acad. Sci. USA* 89, 504; Fox, 2000, *Curr. Med. Chem.*, 7, 17–37; Praseuth et. al., 2000, *Biochim. Biophys. Acta*, 1489, 181–206).

By "double stranded RNA" or "dsRNA" is meant a double stranded RNA that matches a predetermined gene sequence that is capable of activating cellular enzymes that degrade the corresponding messenger RNA transcripts of the gene. These dsRNAs are referred to as short intervening RNA (siRNA) and can be used to inhibit gene expression (see for example Elbashir et al., 2001, *Nature*, 411, 494–498; and Bass, 2001, *Nature*, 411, 428–429). The term "double stranded RNA" or "dsRNA" as used herein refers to a double stranded RNA molecule capable of RNA interference "RNAi", including short interfering RNA "siRNA" see for example Bass, 2001, *Nature*, 411, 428–429; Elbashir et al., 2001, *Nature*, 411, 494–498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914.

By "gene" it is meant a nucleic acid that encodes an RNA, for example, nucleic acid sequences including but not limited to structural genes encoding a polypeptide.

"Complementarity" refers to the ability of a nucleic acid to form hydrogen bond(s) with another RNA sequence by either traditional Watson-Crick or other non-traditional types. In reference to the nucleic molecules of the present invention, the binding free energy for a nucleic acid molecule with its target or complementary sequence is sufficient to allow the relevant function of the nucleic acid to proceed, e.g., enzymatic nucleic acid cleavage, antisense or triple helix inhibition. Determination of binding free energies for nucleic acid molecules is well known in the art (see, e.g., Turner et al., 1987, *CSH Symp. Quant. Biol.* LII pp. 123–133; Frier et al., 1986, *Proc. Nat. Acad. Sci. USA* 83:9373–9377; Turner et al., 1987, *J. Am. Chem. Soc.* 109:3783–3785). A percent complementarity indicates the percentage of contiguous residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence.

By "RNA" is meant a molecule comprising at least one ribonucleotide residue. By "ribonucleotide" or "2'-OH" is meant a nucleotide with a hydroxyl group at the 2' position of a β-D-ribo-furanose moiety.

By "decoy" is meant a nucleic acid molecule, for example RNA or DNA, or aptamer that is designed to preferentially bind to a predetermined ligand. Such binding can result in the inhibition or activation of a target molecule. The decoy or aptamer can compete with a naturally occurring binding target for the binding of a specific ligand. For example, it has been shown that over-expression of HIV trans-activation response (TAR) RNA can act as a "decoy" and efficiently binds HIV tat protein, thereby preventing it from binding to TAR sequences encoded in the HIV RNA (Sullenger et al., 1990, Cell, 63, 601–608). This is but a specific example and those in the art will recognize that other embodiments can be readily generated using techniques generally known in the art, see for example Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628. Similarly, a decoys can be designed to bind to IKK-gamma or PKR and block the binding of IKK-gamma or PKR or a decoy can be designed to bind to IKK-gamma or PKR and prevent interaction with the IKK-garma or PKR protein.

By "aptamer" or "nucleic acid aptamer" as used herein is meant a nucleic acid molecule that binds specifically to a target molecule wherein the nucleic acid molecule has sequence that is distinct from sequence recognized by the target molecule in its natural setting. Alternately, an aptamer can be a nucleic acid molecule that binds to a target molecule where the target molecule does not naturally bind to a nucleic acid. The target molecule can be any molecule of interest. For example, the aptamer can be used to bind to a ligand binding domain of a protein, thereby preventing interaction of the naturally occurring ligand with the protein. Similarly, the nucleic acid molecules of the instant invention can bind to IKK-gamma or PKR to block activity of the respective proteins. This is a non-limiting example and those in the art will recognize that other embodiments can be readily generated using techniques generally known in the art, see for example Gold et al., U.S. Pat. No. 5,475,096 and 5,270,163; Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628.

The enzymatic nucleic acid molecule, antisense nucleic acid or other nucleic acid molecules of the invention that down regulate IKK-gamma or PKR gene expression represent a therapeutic approach to treat a variety of inflammatory-related diseases and conditions, including but not limited to rheumatoid arthritis, restenosis, asthma, Crohn's disease, incontinentia pigmenti, diabetes, obesity, autoimmune disease, lupus, multiple sclerosis, transplant/graft rejection, gene therapy applications, ischemia/reperfusion injury (CNS and myocardial), glomerulonephritis, sepsis, allergic airway inflammation, inflanmmatory bowel disease, infection, and any other inflammatory disease or condition which respond to the modulation of IKK-gamma or PKR function.

The enzymatic nucleic acid molecule, antisense nucleic acid or other nucleic acid molecules of the invention that down regulate IKK-gamma or PKR gene expression also represent a therapeutic approach to treat a variety of cancers, including but not limited to breast, lung, prostate, colorectal, brain, esophageal, bladder, pancreatic, cervical, head and neck, and ovarian cancer, melanoma, lymphoma, glioma, multidrug resistant cancers, and/or other cancers which respond to the modulation of IKK-gamma or PKR function.

In one embodiment of the inventions described herein, the enzymatic nucleic acid molecule is formed in a hammerhead or hairpin motif, but can also be formed in the motif of a hepatitis delta virus, group I intron, group II intron or RNase P RNA (in association with an RNA guide sequence), Neurospora VS RNA, DNAzymes, NCH cleaving motifs, or G-cleavers. Examples of such hammerhead motifs are described by Dreyfus, supra, Rossi et al., 1992, *AIDS Research and Human Retroviruses* 8, 183; of hairpin motifs by Hampel et al., EP0360257, Hampel and Tritz, 1989 *Biochemistry* 28, 4929, Feldstein et al., 1989, *Gene* 82, 53, Haseloff and Gerlach, 1989, *Gene*, 82, 43, and Hampel et al., 1990 *Nucleic Acids Res.* 18, 299; Chowrira & McSwiggen, U.S. Pat. No. 5,631,359; of the hepatitis delta virus motif is described by Perrotta and Been, 1992 *Biochemistry* 31, 16; of the RNase P motif by Guerrier-Takada et al., 1983 *Cell* 35, 849; Forster and Altman, 1990, *Science* 249, 783; Li and Altman, 1996, *Nucleic Acids Res.* 24, 835; *Neurospora* VS RNA ribozyme motif is described by Collins (Saville and Collins, 1990 *Cell* 61, 685–696; Saville and Collins, 1991 *Proc. Natl. Acad. Sci. USA* 88, 8826–8830; Collins and Olive, 1993 *Biochemistry* 32, 2795–2799; Guo and Collins, 1995, *EMBO. J* 14, 363); Group II introns are described by Griffin et al., 1995, *Chem. Biol.* 2, 761; Michels and Pyle, 1995, *Biochemistry* 34, 2965; Pyle et al., International PCT Publication No. WO 96/22689; of the Group I intron by Cech et al., U.S. Pat. No. 4,987,071 and of DNAzymes by Usman et al., International PCT Publication No. WO 95/11304; Chartrand et al., 1995, *NAR* 23, 4092; Breaker et al., 1995, *Chem. Bio.* 2, 655; Santoro et al., 1997, *PNAS* 94, 4262, and Beigelman et al., International PCT publication No. WO 99/55857. NCH cleaving motifs are described in Ludwig & Sproat, International PCT Publication No. WO 98/58058; and G-cleavers are described in Kore et al., 1998, *Nucleic Acids Research* 26, 4116–4120 and Eckstein et al., International PCT Publication No. WO 99/16871. Additional motifs such as the Aptazyme (Breaker et al., WO 98/43993), Amberzyme (Class I motif; FIG. 2; Beigelman et al., U.S. Ser. No. 09/301,511) and Zinzyme (FIG. 3) (Beigelman et al., U.S. Ser. No. 09/301,511), all included by reference herein including drawings, can also be used in the present invention. These specific motifs or configurations are not limiting in the invention and those skilled in the art will recognize that all that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule (Cech et al., U.S. Pat. No. 4,987,071).

In one embodiment of the present invention, a nucleic acid molecule of the instant invention can be between about 10 and 100 nucleotides in length. Exemplary enzymatic nucleic acid molecules of the invention are shown in Tables III to VII. For example, enzymatic nucleic acid molecules of the invention are preferably between about 15 and 50 nucleotides in length, more preferably between about 25 and 40 nucleotides in length, e.g., 34, 36, or 38 nucleotides in length (for example see Jarvis et al., 1996, *J. Biol. Chem.*, 271, 29107–29112). Exemplary DNAzymes of the invention are preferably between about 15 and 40 nucleotides in length, more preferably between about 25 and 35 nucleotides in length, e.g., 29, 30, 31, or 32 nucleotides in length (see for example Santoro et al., 1998, *Biochemistry*, 37, 13330–13342; Chartrand et al., 1995, *Nucleic Acids Research*, 23, 4092–4096). Exemplary antisense molecules of the invention are preferably between about 15 and 75 nucleotides in length, more preferably between about 20 and 35 nucleotides in length, e.g., 25, 26, 27, or 28 nucleotides in length (see for example Woolf et al., 1992, *PNAS.*, 89, 7305–7309; Milner et al., 1997, *Nature Biotechnology*, 15, 537–541). Exemplary triplex forming oligonucleotide molecules of the invention are preferably between about 10 and 40 nucleotides in length, more preferably between about 12 and 25 nucleotides in length, e.g., 18, 19, 20, or 21 nucleotides in length (see for example Maher et al, 1990, *Biochemistry*, 29, 8820–8826; Strobel and Dervan, 1990, *Science*, 249, 73–75). Those skilled in the art will recognize that all that is required is that the nucleic acid molecule be of sufficient length and suitable conformation for the nucleic acid molecule to interact with its target and/or catalyze a reaction contemplated herein. The length of the nucleic acid molecules of the instant invention are not limiting within the general limits stated.

Preferably, a nucleic acid molecule that modulates, for example, down-regulates IKK-gamma or PKR expression comprises between 12 and 100 bases complementary to a RNA molecule of IKK-gamma or PKR. Even more preferably, a nucleic acid molecule that modulates, for example IKK-gamma or PKR expression comprises between 14 and 24 bases complementary to a RNA molecule of IKK-gamma or PKR.

The invention provides a method for producing a class of nucleic acid-based gene modulating agents which exhibit a high degree of specificity for the RNA of a desired target. For example, the enzymatic nucleic acid molecule is preferably targeted to a highly conserved sequence region of target RNAs encoding IKK-gamma or PKR (specifically IKK-gamma or PKR genes) such that specific treatment of a disease or condition can be provided with either one or several nucleic acid molecules of the invention. Such nucleic acid molecules can be delivered exogenously to specific tissue or cellular targets as required. Alternatively, the nucleic acid molecules (e.g., ribozymes and antisense) can be expressed from DNA and/or RNA vectors that are delivered to specific cells.

As used in herein "cell" is used in its usual biological sense, and does not refer to an entire multicellular organism. The cell can, for example, be in vitro, e.g., in cell culture, or present in a multicellular organism, including, e.g., birds, plants and mammals such as humans, cows, sheep, apes, monkeys, swine, dogs, and cats. The cell can be prokaryotic (e.g., bacterial cell) or eukaryotic (e.g., mammalian or plant cell).

By "IKK-gamma proteins" is meant, a peptide or protein comprising a IKK-gamma or NEMO/IKKAP1 component of the IKK complex, for example a regulatory IKK subunit involved in the assembly of the high molecular weight IKK complex and/or induction of NFKB.

By "PKR proteins" is meant, a peptide or protein comprising a protein kinase PKR activity, for example the activation of NFKB.

By "highly conserved sequence region" is meant, a nucleotide sequence of one or more regions in a target gene does not vary significantly from one generation to the other or from one biological system to the other.

Nucleic acid-based inhibitors of IKK-gamma or PKR function are useful for the prevention and/or treatment of cancers and cancerous conditions such as breast, lung, prostate, colorectal, brain, esophageal, bladder, pancreatic, cervical, head and neck, and ovarian cancer, melanoma, lymphoma, glioma, multidrug resistant cancers, and any other diseases or conditions that are related to or will respond to the levels of IKK-gamma or PKR in a cell or tissue, alone or in combination with other therapies.

Nucleic acid-based inhibitors of IKK-gamma or PKR function are also useful for the prevention and/or treatment of inflammatory related diseases and conditions, including but not limited to rheumatoid arthritis, restenosis, asthma, Crohn's disease, incontinentia pigmenti, diabetes, obesity, autoimmune disease, lupus, multiple sclerosis, transplant/graft rejection, gene therapy applications, ischemia/reperfusion injury (CNS and myocardial), glomerulonephritis, sepsis, allergic airway inflammation, inflammatory bowel disease, infection, and any other inflammatory disease or condition which respond to the modulation of IKK-gamma or PKR function.

The nucleic acid-based inhibitors of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through injection or infusion pump, with or without their incorporation in biopolymers. In preferred embodiments, the enzymatic nucleic acid inhibitors comprise sequences, which are complementary to the substrate sequences in Tables III to XIII. Examples of such enzymatic nucleic acid molecules also are shown in Tables III to XIII. Examples of such enzymatic nucleic acid molecules consist essentially of sequences defined in these tables.

In another embodiment, the invention features antisense nucleic acid molecules and 2–5A chimera including sequences complementary to the substrate sequences shown in Tables III to XIII. Such nucleic acid molecules can include sequences as shown for the binding arms of the enzymatic nucleic acid molecules in Tables III to XIII. Similarly, triplex molecules can be provided targeted to the corresponding DNA target regions, and containing the DNA equivalent of a target sequence or a sequence complementary to the specified target (substrate) sequence. Typically, antisense molecules are complementary to a target sequence along a single contiguous sequence of the antisense molecule. However, in certain embodiments, an antisense molecule can bind to substrate such that the substrate molecule forms a loop, and/or an antisense molecule can bind such that the antisense molecule forms a loop. Thus, the antisense molecule can be complementary to two (or even more) non-contiguous substrate sequences or two (or even more) non-contiguous sequence portions of an antisense molecule can be complementary to a target sequence or both.

By "consists essentially of" is meant that the active nucleic acid molecule of the invention, for example, an enzymatic nucleic acid molecule, contains an enzymatic center or core equivalent to those in the examples, and binding arms able to bind RNA such that cleavage at the target site occurs. Other sequences can be present which do not interfere with such cleavage. Thus, a core region can, for example, include one or more loop, stem-loop structure, or linker which does not prevent enzymatic activity. Thus, the underlined regions in the sequences in Tables III, IV, VIII, and IX can be such a loop, stem-loop, nucleotide linker, and/or non-nucleotide linker and can be represented generally as sequence "X". For example, a core sequence for a hammerhead enzymatic nucleic acid can comprise a conserved sequence, such as 5'-CUGAUGAG-3' and 5'-CGAA-3' connected by "X", where X is 5'-<u>GCCGUUAGGC</u>-3' (SEQ ID NO 8002), or any other Stem II region known in the art, or a nucleotide and/or non-nucleotide linker. Similarly, for other nucleic acid molecules of the instant invention, such as Inozyme, G-cleaver, amberzyme, zinzyme, DNAzyme, antisense, 2–5A antisense, triplex forming nucleic acid, and decoy nucleic acids, other sequences or non-nucleotide linkers can be present that do not interfere with the function of the nucleic acid molecule.

Sequence X can be a linker of ≧2 nucleotides in length, preferably 3, 4, 5, 6, 7, 8, 9, 10, 15, 20, 26, 30, where the nucleotides can preferably be internally base-paired to form a stem of preferably ≧2 base pairs. In yet another embodiment, the nucleotide linker X can be a nucleic acid aptamer, such as an ATP aptamer, HIV Rev aptamer (RRE), HIV Tat aptamer (TAR) and others (for a review see Gold et al., 1995, *Annu. Rev. Biochem.*, 64, 763; and Szostak & Ellington, 1993, in *The RNA World*, ed. Gesteland and Atkins, pp. 511, CSH Laboratory Press). A "nucleic acid aptamer" as used herein is meant to indicate a nucleic acid sequence capable of interacting with a ligand. The ligand can be any natural or a synthetic molecule, including but not limited to a resin, metabolites, nucleosides, nucleotides, drugs, toxins, transition state analogs, peptides, lipids, proteins, amino acids, nucleic acid molecules, hormones, carbohydrates, receptors, cells, viruses, bacteria and others.

In yet another embodiment, alternatively or in addition, sequence X can be a non-nucleotide linker. Non-nucleotides as can include abasic nucleotide, polyether, polyamine, polyamide, peptide, carbohydrate, lipid, or polyhydrocarbon compounds. Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al, *Nucleic Acids Res.* 1993, 21:2585 and *Biochemistry* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al., International Publication No. WO 95/11910 and Ferentz and Verdine, *J. Am. Chem. Soc.* 1991, 113:4000, all hereby incorporated by reference herein. A "non-nucleotide" further means any group or compound which can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine. Thus, in a preferred embodiment, the invention features an enzymatic nucleic acid molecule having one or more non-nucleotide moieties, and having enzymatic activity to cleave an RNA or DNA molecule.

In another aspect of the invention, enzymatic nucleic acid molecules or antisense molecules that interact with target RNA molecules and down-regulate IKK-gamma or PKR (specifically IKK-gamma or PKR gene) activity are expressed from transcription units inserted into DNA or RNA vectors. The recombinant vectors are preferably DNA plasmids or viral vectors. Enzymatic nucleic acid molecule or antisense expressing viral vectors can be constructed based on, but not limited to, adeno-associated virus, retrovirus, adenovirus, or alphavirus. Preferably, the recombinant vectors capable of expressing the enzymatic nucleic acid molecules or antisense are delivered as described above, and persist in target cells. Alternatively, viral vectors can be used that provide for transient expression of enzymatic nucleic acid molecules or antisense. Such vectors can be repeatedly administered as necessary. Once expressed, the enzymatic nucleic acid molecules or antisense bind to the target RNA and down-regulate its function or expression. Delivery of enzymatic nucleic acid molecule or antisense expressing vectors can be systemic, such as by intravenous or intramuscular administration, by administration to target cells explanted from the patient or subject followed by reintroduction into the patient or subject, or by any other means that would allow for introduction into the desired target cell. Antisense DNA can be expressed via the use of a single stranded DNA intracellular expression vector.

By "vectors" is meant any nucleic acid- and/or viral-based technique used to deliver a desired nucleic acid.

By "subject" is meant an organism, which is a donor or recipient of explanted cells or the cells themselves. "subject" also refers to an organism to which the nucleic acid molecules of the invention can be administered. Preferably, a subject is a mammal or mammalian cells. More preferably, a subject is a human or human cells.

By "enhanced enzymatic activity" is meant to include activity measured in cells and/or in vivo where the activity is a reflection of both the catalytic activity and the stability of the nucleic acid molecules of the invention. In this invention, the product of these properties can be increased in vivo compared to an all RNA enzymatic nucleic acid or all DNA enzyme. In some cases, the activity or stability of the nucleic acid molecule can be decreased (i.e., less than ten-fold), but the overall activity of the nucleic acid molecule is enhanced, in vivo.

The nucleic acid molecules of the instant invention, individually, or in combination or in conjunction with other drugs, can be used to treat diseases or conditions discussed above. For example, to treat a disease or condition associated with the levels of IKK-gamma or PKR, the subject can be treated, or other appropriate cells can be treated, as is evident to those skilled in the art, individually or in combination with one or more drugs under conditions suitable for the treatment.

In a further embodiment, the described nucleic acid molecules, such as antisense or ribozymes, can be used in combination with other known treatments to treat conditions or diseases discussed above. For example, the described molecules can be used in combination with one or more known therapeutic agents to treat breast, lung, prostate, colorectal, brain, esophageal, bladder, pancreatic, cervical, head and neck, and ovarian cancer, melanoma, lymphoma, glioma, multidrug resistant cancers, rheumatoid arthritis, restenosis, asthma, Crohn's disease, diabetes, incontinentia pigmenti, obesity, autoimmune disease, lupus, multiple sclerosis, transplant/graft rejection, gene therapy applications, ischemia/reperfusion injury (CNS and myocardial), glomerulonephritis, sepsis, allergic airway inflammation, inflammatory bowel disease, infection, and any other cancerous disease or inflammatory disease or condition which respond to the modulation of IKK-gamma or PKR expression.

In another embodiment, the invention features nucleic acid-based inhibitors (e.g., enzymatic nucleic acid molecules (eg; ribozymes), antisense nucleic acids, 2–5A antisense chimeras, triplex DNA, dsRNA, antisense nucleic acids containing RNA cleaving chemical groups) and methods for their use to down regulate or inhibit the expression of genes (e.g., IKK-gamma or PKR) capable of progression and/or maintenance of cancer, inflammatory diseases, and/or other disease states which respond to the modulation of IKK-gamma or PKR expression.

By "comprising" is meant including, but not limited to, whatever follows the word "comprising". Thus, use of the term "comprising" indicates that the listed elements are required or mandatory, but that other elements are optional and can or can not be present. By "consisting of" is meant including, and limited to, whatever follows the phrase "consisting of". Thus, the phrase "consisting of" indicates that the listed elements are required or mandatory, and that no other elements can be present.

Other features and advantages of the invention will be apparent from the following description of the preferred embodiments thereof, and from the claims.

Mechanism of Action of Nucleic Acid Molecules of the Invention as Proposed in the Art Antisense: Antisense molecules can be modified or unmodified RNA, DNA, or mixed polymer oligonucleotides and primarily function by specifically binding to matching sequences resulting in inhibition of peptide synthesis (Wu-Pong, November 1994, *BioPharm*, 20–33). The antisense oligonucleotide binds to target RNA by Watson Crick base-pairing and blocks gene expression by preventing ribosomal translation of the bound sequences either by steric blocking or by activating RNase H enzyme. Antisense molecules can also alter protein synthesis by interfering with RNA processing or transport from the nucleus into the cytoplasm (Mukhopadhyay & Roth, 1996, *Crit. Rev. in Oncogenesis* 7, 151–190).

In addition, binding of single stranded DNA to RNA can result in nuclease degradation of the heteroduplex (Wu-Pong, supra; Crooke, supra). To date, the only backbone modified DNA chemistry which act as substrates for RNase H are phosphorothioates, phosphorodithioates, and borontrifluoridates. Recently it has been reported that 2'-arabino and 2'-fluoro arabino-containing oligos can also activate RNase H activity.

A number of antisense molecules have been described that utilize novel configurations of chemically modified nucleotides, secondary structure, and/or RNase H substrate domains (Woolf et al., International PCT Publication No. WO 98/13526; Thompson et al., International PCT Publication No. WO 99/54459; Hartmann et al., U.S. Ser. No. 60/101,174 which was filed on Sep. 21, 1998) all of these are incorporated by reference herein in their entirety.

In addition, antisense deoxyoligoribonucleotides can be used to target RNA by means of DNA-RNA interactions, thereby activating RNase H, which digests the target RNA in the duplex. Antisense DNA can be expressed via the use of a single stranded DNA intracellular expression vector or equivalents and variations thereof.

Enzymatic Nucleic Acid: Several varieties of enzymatic RNAs are presently known. In addition, several in vitro selection (evolution) strategies (Orgel, 1979, *Proc. R. Soc. London*, B 205, 435) have been used to evolve new nucleic acid catalysts capable of catalyzing cleavage and ligation of phosphodiester linkages (Joyce, 1989, *Gene*, 82, 83–87; Beaudry et al., 1992, *Science* 257, 635–641; Joyce, 1992, *Scientific American* 267, 90–97; Breaker et al., 1994, *TIBTECH* 12, 268; Bartel et al.,1993, *Science* 261:1411–1418; Szostak, 1993, *TIBS* 17, 89–93; Kumar et al., 1995, *FASEB J.*, 9, 1183; Breaker, 1996, *Curr. Op. Biotech.*, 7, 442; Santoro et al., 1997, *Proc. Natl. Acad. Sci.*, 94, 4262; Tang et al., 1997, *RNA* 3, 914; Nakacane & Eckstein, 1994, supra; Long & Uhlenbeck, 1994, supra; Ishizaka et al., 1995, supra; Vaish et al., 1997, *Biochemistry*

36, 6495; all of these are incorporated by reference herein). Each can catalyze a series of reactions including the hydrolysis of phosphodiester bonds in trans (and thus can cleave other RNA molecules) under physiological conditions.

Nucleic acid molecules of this invention will block to some extent IKK-gamma or PKR and/or IKK-gamma or PKR protein expression and can be used to treat disease or diagnose disease associated with the levels of IKK-gamma or PKR and/or IKK-gamma or PKR. Enzymatic nucleic acid sequences targeting IKK-gamma or PKR RNA and sequences that can be targeted with nucleic acid molecules of the invention to down-regulate IKK-gamma or PKR expression are shown in Tables III to XIII.

The enzymatic nature of an enzymatic nucleic acid molecule can allow the concentration of enzymatic nucleic acid molecule necessary to affect a therapeutic treatment to be lower. This reflects the ability of the enzymatic nucleic acid molecule to act enzymatically. Thus, a single enzymatic nucleic acid molecule is able to cleave many molecules of target RNA. In addition, the enzymatic nucleic acid molecule is a highly specific inhibitor, with the specificity of inhibition depending not only on the base-pairing mechanism of binding to the target RNA, but also on the mechanism of target RNA cleavage. Single mismatches, or base-substitutions, near the site of cleavage can be chosen to greatly attenuate the catalytic activity of a enzymatic nucleic acid molecule.

Nucleic acid molecules having an endonuclease enzymatic activity are able to repeatedly cleave other separate RNA molecules in a nucleotide base sequence-specific manner. Such enzymatic nucleic acid molecules can be targeted to virtually any RNA transcript, and achieve efficient cleavage in vitro (Zaug et al., 324, *Nature* 429 1986; Uhlenbeck, 1987 *Nature* 328, 596; Kim et al., 84 *Proc. Natl. Acad. Sci. USA* 8788, 1987; Dreyfus, 1988, *Einstein Quart. J. Bio. Med.*, 6, 92; Haseloff and Gerlach, 334 *Nature* 585, 1988; Cech, 260 *JAMA* 3030, 1988; and Jefferies et al., 17 *Nucleic Acids Research* 1371, 1989; Santoro et al., 1997 supra).

Because of their sequence specificity, trans-cleaving enzymatic nucleic acid molecules can be used as therapeutic agents for human disease (Usman & McSwiggen, 1995 *Ann. Rep. Med. Chem.* 30, 285–294; Christoffersen and Marr, 1995 *J. Med. Chem.* 38, 2023–2037). Enzymatic nucleic acid molecules can be designed to cleave specific RNA targets within the background of cellular RNA. Such a cleavage event renders the RNA non-functional and abrogates protein expression from that RNA. In this manner, synthesis of a protein associated with a disease state can be selectively inhibited (Warashina et al., 1999, *Chemistry and Biology*, 6, 237–250).

Enzymatic nucleic acid molecules of the invention that are allosterically regulated ("allozymes") can be used to modulate IKK-gamma or PKR expression. These allosteric enzymatic nucleic acids or allozymes (see for example George et al, U.S. Pat. Nos. 5,834,186 and 5,741,679, Shih et al., U.S. Pat. No. 5,589,332, Nathan et al., U.S. Pat. No. 5,871,914, Nathan and Ellington, International PCT publication No. WO 00/24931, Breaker et al., International PCT Publication Nos. WO 00/26226 and 98/27104, and Sullenger et al., International PCT publication No. WO 99/29842) are designed to respond to a signaling agent, for example, mutant IKK-gamma protein, wild-type IKK-gamma protein, mutant IKK-gamma RNA, wild-type IKK-gainma RNA, other proteins and/or RNAs involved in IKK-gamma activity, compounds, metals, polymers, molecules and/or drugs that are targeted to IKK-gamma or an IKK subunit, such as IKK-alpha or IKK-beta, expressing cells etc., which in turn modulates the activity of the enzymatic nucleic acid molecule. In response to interaction with a predetermined signaling agent, the allosteric enzymatic nucleic acid molecule's activity is activated or inhibited such that the expression of a particular target is selectively down-regulated. The target can comprise wild-type IKK-gamma, mutant IKK-gamma, a component of IKK-gamma, and/or a predetermined cellular component that modulates IKK-gamnma activity. In a specific example, allosteric enzymatic nucleic acid molecules that are activated by interaction with a RNA encoding a mutant IKK-gamma protein are used as therapeutic agents in vivo. The presence of RNA encoding the mutant IKK-gamma activates the allosteric enzymatic nucleic acid molecule that subsequently cleaves the RNA encoding a mutant IKK-gamma protein resulting in the inhibition of mutant IKK-gamma protein expression. In this manner, cells that express the mutant form of the IKK-gamma protein are selectively targeted. Such an approach, can be used to treat, for example, incontinentia pigmenti.

In another non-limiting example, an allozyme can be activated by a IKK-gamma or PKR protein, peptide, or mutant polypeptide that caused the allozyme to inhibit the expression of IKK-gamma or PKR gene, by, for example, cleaving RNA encoded by IKK-gamma or PKR gene. In this non-limiting example, the allozyme acts as a decoy to inhibit the function of IKK-gamma or PKR and also inhibit the expression of IKK-gamma or PKR once activated by the IKK-gamma or PKR protein.

The nucleic acid molecules of the instant invention are also referred to as GeneBloc reagents, which are essentially nucleic acid molecules (eg; ribozymes, antisense) capable of down-regulating gene expression.

Target Sites

Targets for useful enzymatic nucleic acid molecules and antisense nucleic acids can be determined as disclosed in Draper et al., WO 93/23569; Sullivan et al., WO 93/23057; Thompson et al., WO 94/02595; Draper et al., WO 95/04818; McSwiggen et al., U.S. Pat. No. 5,525,468, and hereby incorporated by reference herein in totality. Other examples include the following PCT applications, which concern inactivation of expression of disease-related genes: WO 95/23225, WO 95/13380, WO 94/02595, incorporated by reference herein. Rather than repeat the guidance provided in those documents here, below are provided specific examples of such methods, not limiting to those in the art. Enzymatic nucleic acid molecules and antisense to such targets are designed as described in those applications and synthesized to be tested in vitro and in vivo, as also described. The sequences of human IKK-gamma or PKR RNAs were screened for optimal enzymatic nucleic acid and antisense target sites using a computer-folding algorithm. Antisense, hammerhead, DNAzyme, NCH, amberzyme, zinzyme, or G-Cleaver enzymatic nucleic acid molecule binding/cleavage sites were identified. These sites are shown in Tables III to XIII (all sequences are 5' to 3' in the tables; underlined regions can be any sequence "X" or linker X, the actual sequence is not relevant here). The nucleotide base position is noted in the Tables as that site to be cleaved by the designated type of enzymatic nucleic acid molecule. While human sequences can be screened and enzymatic nucleic acid molecule and/or antisense thereafter designed, as discussed in Stinchcomb et al., WO 95/23225, mouse targeted enzymatic nucleic acid molecules can be useful to test efficacy of action of the enzymatic nucleic acid molecule and/or antisense prior to testing in humans.

Antisense, hammerhead, DNAzyme, NCH, amberzyme, zinzyme or G-Cleaver enzymatic nucleic acid molecule binding/cleavage sites were identified. The nucleic acid molecules are individually analyzed by computer folding (Jaeger et al., 1989 *Proc. Natl. Acad. Sci. USA*, 86, 7706) to assess whether the sequences fold into the appropriate secondary structure. Those nucleic acid molecules with unfavorable intramolecular interactions such as between the binding arms and the catalytic core are eliminated from consideration. Varying binding arm lengths can be chosen to optimize activity.

Antisense, hammerhead, DNAzyme, NCH, amberzyme, zinzyme or G-Cleaver enzymatic nucleic acid molecule binding/cleavage sites were identified and were designed to anneal to various sites in the RNA target. The binding arms are complementary to the target site sequences described above. The nucleic acid molecules were chemically synthesized. The method of synthesis used follows the procedure for normal DNA/RNA synthesis as described below and in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684; Caruthers et al., 1992, *Methods in Enzymology* 211,3–19.

Synthesis of Nucleic Acid Molecules

Synthesis of nucleic acids greater than 100 nucleotides in length can be difficult using automated methods, and the therapeutic cost of such molecules can be prohibitive. In this invention, small nucleic acid motifs ("small refers to nucleic acid motifs less than about 100 nucleotides in length, preferably less than about 80 nucleotides in length, and more preferably less than about 50 nucleotides in length; e.g., antisense oligonucleotides, hammerhead or the NCH ribozymes) are preferably used for exogenous delivery. The simple structure of these molecules increases the ability of the nucleic acid to invade targeted regions of RNA structure. Exemplary molecules of the instant invention are chemically synthesized, and others can similarly be synthesized.

Oligonucleotides (eg; antisense, GeneBlocs) are synthesized using protocols known in the art as described in Caruthers et al., 1992, *Methods in Enzymology* 211, 3–19, Thompson et al., International PCT Publication No. WO 99/54459, Wincott et al., 1995, *Nucleic Acids Res.* 23, 2677–2684, Wincott et al., 1997, *Methods Mol. Bio.*, 74, 59, Brennan et al, 1998, *Biotechnol Bioeng.*, 61, 33–45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 2.5 min coupling step for 2'-O-methylated nucleotides and a 45 sec coupling step for 2'-deoxy nucleotides. Table II outlines the amounts and the contact times of the reagents used in the synthesis cycle. Alternatively, syntheses at the 0.2 μmol scale can be performed on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 105-fold excess of S-ethyl tetrazole (60 μL of 0.25 M=15 μmol) can be used in each coupling cycle of 2'-O-methyl residues relative to polymer-bound 5'-hydroxyl. A 22-fold excess (40 μL of 0.11 M=4.4 μmol) of deoxy phosphoramidite and a 70-fold excess of S-ethyl tetrazole (40 μL of 0.25 M=10 μmol) can be used in each coupling cycle of deoxy residues relative to polymer-bound 5'-hydroxyl. Average coupling yields on the 394 Applied Biosystems, Inc. synthesizer, determined by calorimetric quantitation of the trityl fractions, are typically 97.5–99%. Other oligonucleotide synthesis reagents for the 394 Applied Biosystems, Inc. synthesizer include; detritylation solution is 3% TCA in methylene chloride (ABI); capping is performed with 16% N-methylimidazole in THF (ABI) and 10% acetic anhydride/10% 2,6-lutidine in THF (ABI); and oxidation solution is 16.9 mM $I_2$, 49 mM pyridine, 9% water in THF (PERSEPTIVE#). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide, 0.05 M in acetonitrile) is used.

Deprotection of the antisense oligonucleotides is performed as follows: the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder.

The method of synthesis used for RNA and chemically modified RNA including certain enzymatic nucleic acid molecules follows the procedure as described in Usman et al., 1987, *J. Am. Chem. Soc.*, 109, 7845; Scaringe et al., 1990, *Nucleic Acids Res.*, 18, 5433; and Wincott et al, 1995, *Nucleic Acids Res.* 23, 2677–2684 Wincott et al., 1997, *Methods Mol Bio.*, 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 7.5 min coupling step for alkylsilyl protected nucleotides and a 2.5 min coupling step for 2'-O-methylated nucleotides. Table II outlines the amounts and the contact times of the reagents used in the synthesis cycle. Alternatively, syntheses at the 0.2 μmol scale can be done on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 75-fold excess of S-ethyl tetrazole (60 μL of 0.25 M=15 μmol) can be used in each coupling cycle of 2'-O-methyl residues relative to polymer-bound 5'-hydroxyl. A 66-fold excess (120 μL of 0.11 M=13.2 μmol) of alkylsilyl (ribo) protected phosphoramidite and a 150-fold excess of S-ethyl tetrazole (120 μL of 0.25 M=30 μmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5–99%. Other oligonucleotide synthesis reagents for the 394 Applied Biosystems, Inc. synthesizer include; detritylation solution is 3% TCA in methylene chloride (ABI); capping is performed with 16% N-methylimidazole in THF (ABI) and 10% acetic anhydride/10% 2,6-lutidine in THF (ABI); oxidation solution is 16.9 mM $I_2$, 49 mM pyridine, 9% water in THF (PERSEPTIVE™). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide 0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 μL of a solution of 1.5 mL N-methylpyrrolidinone, 750 μL TEA and 1 mL TEA.3HF to provide a 1.4 M HF concentration) and heated to 65° C. After 1.5 h, the oligomer is quenched with 1.5 M $NH_4HCO_3$.

Alternatively, for the one-pot protocol, the polymer-bound trityl-on oligoribonucleotide is transferred to a 4 mL glass screw top vial and suspended in a solution of 33% ethanolic methylamine/DMSO: 1/1 (0.8 mL) at 65° C. for 15 min. The vial is brought to r.t. TEA.3HF (0.1 mL) is added and the vial is heated at 65° C. for 15 min. The sample is cooled at −20° C. and then quenched with 1.5 M $NH_4HCO_3$.

For purification of the trityl-on oligomers, the quenched $NH_4HCO_3$ solution is loaded onto a C-18 containing cartridge that had been prewashed with acetonitrile followed by 50 mM TEAA. After washing the loaded cartridge with water, the RNA is detritylated with 0.5% TFA for 13 min. The cartridge is then washed again with water, salt exchanged with 1 M NaCl and washed with water again. The oligonucleotide is then eluted with 30% acetonitrile.

Inactive hammerhead ribozymes or binding attenuated control (BAC) oligonucleotides can be synthesized by substituting a U for $G_5$ and a U for $A_{14}$ (numbering from Hertel, K. J., et al., 1992, *Nucleic Acids Res.*, 20, 3252). Similarly, one or more nucleotide substitutions can be introduced in other enzymatic nucleic acid molecules to inactivate the molecule and such molecules can serve as a negative control.

The average stepwise coupling yields are typically >98% (Wincott et al., 1995 *Nucleic Acids Res.* 23, 2677–2684). Those of ordinary skill in the art will recognize that the scale of synthesis can be adapted to be larger or smaller than the example described above including but not limited to 96 well format, with the ratio of chemicals being used in the reaction adjusted accordingly.

Alternatively, the nucleic acid molecules of the present invention can be synthesized separately and joined together post-synthetically, for example by ligation (Moore et al., 1992, *Science* 256, 9923; Draper et al., International PCT publication No. WO 93/23569; Shabarova et al., 1991, *Nucleic Acids Research* 19, 4247; Bellon et al., 1997, *Nucleosides & Nucleotides*, 16, 951; Bellon et al., 1997, *Bioconjugate Chem.* 8, 204).

The nucleic acid molecules of the present invention are modified extensively to enhance stability by modification with nuclease resistant groups, for example, 2'-amino, 2'-C-allyl, 2'-flouro, 2'-O-methyl, 2'-H (for a review see Usman and Cedergren, 1992, *TIBS* 17, 34; Usman et al., 1994, *Nucleic Acids Symp. Ser.* 31, 163). Ribozymes are purified by gel electrophoresis using general methods or are purified by high pressure liquid chromatography (HPLC; See Wincott et al., Supra, the totality of which is hereby incorporated herein by reference) and are re-suspended in water.

The sequences of the nucleic acid molecules, including enzymatic nucleic acid molecules and antisense, that are chemically synthesized, are shown in Table XIII. The sequences of the enzymatic nucleic acid and antisense constructs that are chemically synthesized, are complementary to the Substrate sequences shown in Table XIII. Those in the art will recognize that these sequences are representative only of many more such sequences where the enzymatic portion of the ribozyme (all but the binding arms) is altered to affect activity. The enzymatic nucleic acid and antisense construct sequences listed in Tables III to XIII can be formed of ribonucleotides or other nucleotides or non-nucleotides. Such enzymatic nucleic acid molecules with enzymatic activity are equivalent to the enzymatic nucleic acid molecules described specifically in the Tables.

Optimizing Activity of the Nucleic Acid Molecule of the Invention

Chemically synthesizing nucleic acid molecules with modifications (base, sugar and/or phosphate) that prevent their degradation by serum ribonucleases can increase their potency (see e.g., Eckstein et al., International Publication No. WO 92/07065; Perrault et al., 1990 *Nature* 344, 565; Pieken et al., 1991, *Science* 253, 314; Usman and Cedergren, 1992, *Trends in Biochem. Sci.* 17, 334; Usman et al., International Publication No. WO 93/15187; and Rossi et al., International Publication No. WO 91/03162; Sproat, U.S. Pat. No. 5,334,711; and Burgin et al., supra; all of these describe various chemical modifications that can be made to the base, phosphate and/or sugar moieties of the nucleic acid molecules herein). Modifications which enhance their efficacy in cells, and removal of bases from nucleic acid molecules to shorten oligonucleotide synthesis times and reduce chemical requirements are desired. (All these publications are hereby incorporated by reference herein).

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-flouro, 2'-O-methyl, 2'-H, nucleotide base modifications (for a review see Usman and Cedergren, 1992, *TIBS.* 17, 34; Usman et al., 1994, *Nucleic Acids Symp. Ser.* 31, 163; Burgin et al., 1996, *Biochemistry*, 35, 14090). Sugar modification of nucleic acid molecules have been extensively described in the art (see Eckstein et al., International Publication PCT No. WO 92/07065; Perrault et al. *Nature,* 1990, 344, 565–568; Pieken et al. *Science,* 1991, 253, 314–317; Usman and Cedergren, *Trends in Biochem. Sci.* , 1992, 17, 334–339; Usman et al. *International Publication* PCT No. WO 93/15187; Sproat, U.S. Pat. No. 5,334,711 and Beigelman et al., 1995, *J. Biol. Chem.,* 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.,* 39, 1131; Earnshaw and Gait, 1998, *Biopolymers (Nucleic acid Sciences)*, 48, 39–55; Verma and Eckstein, 1998, *Annu. Rev. Biochem.,* 67, 99–134; and Burlina et al., 1997, *Bioorg. Med. Chem.,* 5, 1999–2010; all of the references are hereby incorporated in their totality by reference herein). Such publications describe general methods and strategies to determine the location of incorporation of sugar, base and/or phosphate modifications and the like into ribozymes without inhibiting catalysis, and are incorporated by reference herein. In view of such teachings, similar modifications can be used as described herein to modify the nucleic acid molecules of the instant invention.

While chemical modification of oligonucleotide internucleotide linkages with phosphorothioate, phosphorothioate, and/or 5'-methylphosphonate linkages improves stability, too many of these modifications can cause some toxicity. Therefore when designing nucleic acid molecules the amount of these internucleotide linkages should be minimized. The reduction in the concentration of these linkages should lower toxicity resulting in increased efficacy and higher specificity of these molecules.

Nucleic acid molecules having chemical modifications that maintain or enhance activity are provided. Such nucleic acid is also generally more resistant to nucleases than unmodified nucleic acid. Thus, in a cell and/or in vivo the activity can not be significantly lowered. Therapeutic nucleic acid molecules delivered exogenously are optimally stable within cells until translation of the target RNA has been inhibited long enough to reduce the levels of the undesirable protein. This period of time varies between hours to days depending upon the disease state. Nucleic acid molecules are preferably resistant to nucleases in order to function as effective intracellular therapeutic agents. Improvements in the chemical synthesis of RNA and DNA (Wincott et al., 1995 *Nucleic Acids Res.* 23, 2677; Caruthers et al., 1992, *Methods in Enzymology* 211,3–19 (incorporated by reference herein) have expanded the ability to modify nucleic acid molecules by introducing nucleotide modifications to enhance their nuclease stability as described above.

Use of the nucleic acid-based molecules of the invention can lead to better treatment of the disease progression by affording the possibility of combination therapies (e.g., multiple antisense or enzymatic nucleic acid molecules targeted to different genes, nucleic acid molecules coupled with known small molecule inhibitors, or intermittent treatment with combinations of molecules (including different motifs) and/or other chemical or biological molecules). The treatment of subjects with nucleic acid molecules can also include combinations of different types of nucleic acid molecules.

Therapeutic nucleic acid molecules (e.g., enzymatic nucleic acid molecules and antisense nucleic acid molecules) delivered exogenously are optimally stable within cells until translation of the target RNA has been inhibited long enough to reduce the levels of the undesirable protein. This period of time varies between hours to days depending upon the disease state. These nucleic acid molecules should be resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In one embodiment, nucleic acid catalysts having chemical modifications that maintain or enhance enzymatic activity are provided. Such nucleic acids are also generally more resistant to nucleases than unmodified nucleic acid. Thus, in a cell and/or in vivo the activity of the nucleic acid can not be significantly lowered. As exemplified herein such enzymatic nucleic acids are useful in a cell and/or in vivo even if activity over all is reduced about 10 fold (Burgin et al., 1996, *Biochemistry*, 35, 14090). Such enzymatic nucleic acids herein are said to "maintain" the enzymatic activity of an all RNA ribozyme or all DNA DNAzyme.

In another aspect the nucleic acid molecules comprise a 5' and/or a 3'-cap structure.

By "cap structure" is meant chemical modifications, which have been incorporated at either terminus of the oligonucleotide (see for example Wincott et al, WO 97/26270, incorporated by reference herein). These terminal modifications protect the nucleic acid molecule from exonuclease degradation, and can help in delivery and/or localization within a cell. The cap can be present at the 5'-terminus (5'-cap) or at the 3'-terminus (3'-cap) or can be present on both terminus. In non-limiting examples, the 5'-cap includes inverted abasic residue (moiety), 4',5'-methylene nucleotide; 1-(beta-D-erythrofuranosyl) nucleotide, 4'-thio nucleotide, carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety (for more details see Wincott et al., International PCT publication No. WO 97/26270, incorporated by reference herein).

In another embodiment the 3'-cap includes, for example 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine.

The term "alkyl" as used herein refers to a saturated aliphatic hydrocarbon, including straight-chain, branched-chain "isoalkyl", and cyclic alkyl groups. The term "alkyl" also comprises alkoxy, alkyl-thio, alkyl-thio-alkyl, alkoxyalkyl, alkylamino, alkenyl, alkynyl, alkoxy, cycloalkenyl, cycloalkyl, cycloalkylalkyl, heterocycloalkyl, heteroaryl, C1–C6 hydrocarbyl, aryl or substituted aryl groups. Preferably, the alkyl group has 1 to 12 carbons. More preferably it is a lower alkyl of from about 1 to 7 carbons, more preferably about 1 to 4 carbons. The alkyl group can be substituted or unsubstituted. When substituted the substituted group(s) preferably comprise hydroxy, oxy, thio, amino, nitro, cyano, alkoxy, alkyl-thio, alkyl-thio-alkyl, alkoxyalkyl, alkylamino, silyl, alkenyl, alkynyl, alkoxy, cycloalkenyl, cycloalkyl, cycloalkylalkyl, heterocycloalkyl, heteroaryl, C1–C6 hydrocarbyl, aryl or substituted aryl groups. The term "alkyl" also includes alkenyl groups containing at least one carbon-carbon double bond, including straight-chain, branched-chain, and cyclic groups. Preferably, the alkenyl group has about 2 to 12 carbons. More preferably it is a lower alkenyl of from about 2 to 7 carbons, more preferably about 2 to 4 carbons. The alkenyl group can be substituted or unsubstituted. When substituted the substituted group(s) preferably comprise hydroxy, oxy, thio, amino, nitro, cyano, alkoxy, alkyl-thio, alkyl-thio-alkyl, alkoxyalkyl, alkylamino, silyl, alkenyl, alkynyl, alkoxy, cycloalkenyl, cycloalkyl, cycloalkylalkyl, heterocycloalkyl, heteroaryl, $C_1$–$C_6$ hydrocarbyl, aryl or substituted aryl groups. The term "alkyl" also includes alkynyl groups containing at least one carbon-carbon triple bond, including straight-chain, branched-chain, and cyclic groups. Preferably, the alkynyl group has about 2 to 12 carbons. More preferably it is a lower alkynyl of from about 2 to 7 carbons, more preferably about 2 to 4 carbons. The alkynyl group can be substituted or unsubstituted. When substituted the substituted group(s) preferably comprise hydroxy, oxy, thio, amino, nitro, cyano, alkoxy, alkyl-thio, alkyl-thio-alkyl, alkoxyalkyl, alkylamino, silyl, alkenyl, alkynyl, alkoxy, cycloalkenyl, cycloalkyl, cycloalkylalkyl, heterocycloalkyl, heteroaryl, C1–C6 hydrocarbyl, aryl or substituted aryl groups. Alkyl groups or moieties of the invention can also include aryl, alkylaryl, carbocyclic aryl, heterocyclic aryl, amide and ester groups. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from about 1 to 3 heteroatoms as ring atoms in the aromatic ring and the remainder of the ring atoms are carbon atoms. Suitable heteroatoms include oxygen, sulfur, and nitrogen, and include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

The term "alkoxyalkyl" as used herein refers to an alkyl-O-alkyl ether, for example methoxyethyl or ethoxymethyl.

The term "alkyl-thio-alkyl" as used herein refers to an alkyl-S-alkyl thioether, for example methylthiomethyl or methylthioethyl.

The term "amino" as used herein refers to a nitrogen containing group as is known in the art derived from ammonia by the replacement of one or more hydrogen radicals by organic radicals. For example, the terms "aminoacyl" and "aminoalkyl" refer to specific N-substituted organic radicals with acyl and alkyl substituent groups respectively.

The term "amination" as used herein refers to a process in which an amino group or substituted amine is introduced into an organic molecule.

The term "exocyclic amine protecting moiety" as used herein refers to a nucleobase amino protecting group compatible with oligonucleotide synthesis, for example an acyl or amide group.

The term "alkenyl" as used herein refers to a straight or branched hydrocarbon of a designed number of carbon atoms containing at least one carbon-carbon double bond. Examples of "alkenyl" include vinyl, allyl, and 2-methyl-3-heptene.

The term "alkoxy" as used herein refers to an alkyl group of indicated number of carbon atoms attached to the parent molecular moiety through an oxygen bridge. Examples of alkoxy groups include, for example, methoxy, ethoxy, propoxy and isopropoxy.

The term "alkynyl" as used herein refers to a straight or branched hydrocarbon of a designed number of carbon atoms containing at least one carbon-carbon triple bond. Examples of "alkynyl" include propargyl, propyne, and 3-hexyne.

The term "aryl" as used herein refers to an aromatic hydrocarbon ring system containing at least one aromatic ring. The aromatic ring can optionally be fused or otherwise attached to other aromatic hydrocarbon rings or non-aromatic hydrocarbon rings. Examples of aryl groups include, for example, phenyl, naphthyl, 1,2,3,4-tetrahydronaphthalene and biphenyl. Preferred examples of aryl groups include phenyl and naphthyl.

The term "cycloalkenyl" as used herein refers to a C3–C8 cyclic hydrocarbon containing at least one carbon-carbon double bond. Examples of cycloalkenyl include cyclopropenyl, cyclobutenyl, cyclopentenyl, cyclopentadiene, cyclohexenyl, 1,3-cyclohexadiene, cycloheptenyl, cycloheptatrienyl, and cyclooctenyl.

The term "cycloalkyl" as used herein refers to a C3–C8 cyclic hydrocarbon. Examples of cycloalkyl include cyclopropyl, cyclobutyl, cyclopentyl, cyclohexyl, cycloheptyl and cyclooctyl.

The term "cycloalkylalkyl," as used herein, refers to a C3–C7 cycloalkyl group attached to the parent molecular moiety through an alkyl group, as defined above. Examples of cycloalkylalkyl groups include cyclopropylmethyl and cyclopentylethyl.

The terms "halogen" or "halo" as used herein refers to indicate fluorine, chlorine, bromine, and iodine.

The term "heterocycloalkyl," as used herein refers to a non-aromatic ring system containing at least one heteroatom selected from nitrogen, oxygen, and sulfur. The heterocycloalkyl ring can be optionally fused to or otherwise attached to other heterocycloalkyl rings and/or non-aromatic hydrocarbon rings. Preferred heterocycloalkyl groups have from 3 to 7 members. Examples of heterocycloalkyl groups include, for example, piperazine, morpholine, piperidine, tetrahydrofuran, pyrrolidine, and pyrazole. Preferred heterocycloalkyl groups include piperidinyl, piperazinyl, morpholinyl, and pyrolidinyl.

The term "heteroaryl" as used herein refers to an aromatic ring system containing at least one heteroatom selected from nitrogen, oxygen, and sulfur. The heteroaryl ring can be filsed or otherwise attached to one or more heteroaryl rings, aromatic or non-aromatic hydrocarbon rings or heterocycloalkyl rings. Examples of heteroaryl groups include, for example, pyridine, furan, thiophene, 5,6,7,8-tetrahydroisoquinoline and pyrimidine. Preferred examples of heteroaryl groups include thienyl, benzothienyl, pyridyl, quinolyl, pyrazinyl, pyrimidyl, imidazolyl, benzimidazolyl, furanyl, benzofuranyl, thiazolyl, benzothiazolyl, isoxazolyl, oxadiazolyl, isothiazolyl, benzisothiazolyl, triazolyl, tetrazolyl, pyrrolyl, indolyl, pyrazolyl, and benzopyrazolyl.

The term "C1–C6 hydrocarbyl" as used herein refers to straight, branched, or cyclic alkyl groups having 1–6 carbon atoms, optionally containing one or more carbon-carbon double or triple bonds. Examples of hydrocarbyl groups include, for example, methyl, ethyl, propyl, isopropyl, n-butyl, sec-butyl, tert-butyl, pentyl, 2-pentyl, isopentyl, neopentyl, hexyl, 2-hexyl, 3-hexyl, 3-methylpentyl, vinyl, 2-pentene, cyclopropylmethyl, cyclopropyl, cyclohexylmethyl, cyclohexyl and propargyl. When reference is made herein to C1–C6 hydrocarbyl containing one or two double or triple bonds it is understood that at least two carbons are present in the alkyl for one double or triple bond, and at least four carbons for two double or triple bonds.

By "nucleotide" is meant a heterocyclic nitrogenous base in N-glycosidic linkage with a phosphorylated sugar. Nucleotides are recognized in the art to include natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see for example, Usman and McSwiggen, supra; Eckstein et al., International PCT Publication No. WO 92/07065; Usman et al., International PCT Publication No. WO 93/15187; Uhlman & Peyman, supra all are hereby incorporated by reference herein). There are several examples of modified nucleic acid bases known in the art as summarized by Limbach et al., 1994, Nucleic Acids Res. 22, 2183. Some of the non-limiting examples of chemically modified and other natural nucleic acid bases that can be introduced into nucleic acids include, for example, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, quesosine, 2-thiouridine, 4-thiouridine, wybutosine, wybutoxosine, 4-acetylcytidine, 5-(carboxyhydroxymethyl)uridine, 5'-carboxymethylaminomethyl-2-thiouridine, 5-carboxymethylaminomethyluridine, beta-D-galactosylqueosine, 1-methyladenosine, 1-methylinosine, 2,2-dimethylguanosine, 3-methylcytidine, 2-methyladenosine, 2-methylguanosine, N6-methyladenosine, 7-methylguanosine, 5-methoxyaminomethyl-2-thiouridine, 5-methylaminomethyluridine, 5-methylcarbonyhnethyluridine, 5-methyloxyuridine, 5-methyl-2-thiouridine, 2-methylthio-N6-isopentenyladenosine, beta-D-mannosylqueosine, uridine-5-oxyacetic acid, 2-thiocytidine, threonine derivatives and others (Burgin et al., 1996, Biochemistry, 35, 14090; Uhlman & Peyman, supra). By "modified bases" in this aspect is meant nucleotide bases other than adenine, guanine, cytosine and uracil at 1' position or their equivalents; such bases can be used at any position, for example, within the catalytic core of an enzymatic nucleic acid molecule and/or in the substrate-binding regions of the nucleic acid molecule.

By "nucleoside" is meant a heterocyclic nitrogenous base in N-glycosidic linkage with a sugar. Nucleosides are recognized in the art to include natural bases (standard), and modified bases well known in the art. Such bases are generally located at the 1' position of a nucleoside sugar moiety. Nucleosides generally comprise a base and sugar group. The nucleosides can be unmodified or modified at the sugar, and/or base moiety, (also referred to interchangeably as nucleoside analogs, modified nucleosides, non-natural nucleosides, non-standard nucleosides and other; see for example, Usman and McSwiggen, supra; Eckstein et al., International PCT Publication No. WO 92/07065; Usman et al, International PCT Publication No. WO 93/15187; Uhl-man & Peyman, supra all are hereby incorporated by reference herein). There are several examples of modified nucleic acid bases known in the art as summarized by Limbach et al., 1994, Nucleic Acids Res. 22, 2183. Some of the non-limiting examples of chemically modified and other natural nucleic acid bases that can be introduced into nucleic acids include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, quesosine, 2-thiouridine, 4-thiouridine, wybutosine, wybutoxosine, 4-acetylcytidine, 5-(carboxyhydroxymethyl)uridine, 5'-carboxymethylaminomethyl-2-thiouridine, 5-carboxymethylaminomethyluridine, beta-D-galactosylqueosine, 1-methyladenosine, 1-methylinosine, 2,2-dimethylguanosine, 3-methylcytidine, 2-methyladenosine, 2-methylguanosine, N6-methyladenosine, 7-methylguanosine, 5-methoxyaminomethyl-2-thiouridine, 5-methylaminomethyluridine, 5-methylcarbonylmethyluridine, 5-methyloxyuridine, 5-methyl-2-thiouridine, 2-methylthio-N6-isopentenyladenosine, beta-D-mannosylqueosine, uridine-5-oxyacetic acid, 2-thiocytidine, threonine derivatives and others (Burgin et al, 1996, Biochemistry, 35, 14090; Uhlman & Peyman, supra). By "modified bases" in this aspect is meant nucleoside bases other than adenine, guanine, cytosine and uracil at 1' position or their equivalents; such bases can be used at any position, for example, within the catalytic core of an enzymatic nucleic acid molecule and/or in the substrate-binding regions of the nucleic acid molecule.

In one embodiment, the invention features modified enzymatic nucleic acid molecules with phosphate backbone modifications comprising one or more phosphorothioate, phosphorodithioate, methylphosphonate, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications see Hunziker and Leumann, 1995, *Nucleic Acid Analogues: Synthesis and Properties*, in *Modern Synthetic Methods*, VCH, 331–417, and Mesmaeker et al., 1994, *Novel Backbone Replacements for Oligonucleotides*, in *Carbohydrate Modifications in Antisense Research*, ACS, 24–39. These references are hereby incorporated by reference herein.

By "abasic" is meant sugar moieties lacking a base or having other chemical groups in place of a base at the 1' position, for example a 3',3'-linked or 5',5'-linked deoxyabasic ribose derivative (for more details see Wincott et al., International PCT publication No. WO 97/26270).

By "unmodified nucleoside" is meant one of the bases adenine, cytosine, guanine, thymine, uracil joined to the 1' carbon of β-D-ribo-furanose.

By "modified nucleoside" is meant any nucleotide base which contains a modification in the chemical structure of an unmodified nucleotide base, sugar and/or phosphate.

In connection with 2'-modified nucleotides as described for the present invention, by "amino" is meant 2'-NH$_2$ or 2'-O—NH$_2$, which can be modified or unmodified. Such modified groups are described, for example, in Eckstein et al., U.S. Pat. No. 5,672,695 and Matulic-Adamic et al, WO 98/28317, respectively, which are both incorporated by reference in their entireties.

Various modifications to nucleic acid (e.g., antisense and ribozyme) structure can be made to enhance the utility of these molecules. For example, such modifications can enhance shelf-life, half-life in vitro, stability, and ease of introduction of such oligonucleotides to the target site, including e.g., enhancing penetration of cellular membranes and conferring the ability to recognize and bind to targeted cells.

Use of these molecules can lead to better treatment of the disease progression by affording the possibility of combination therapies (e.g., multiple enzymatic nucleic acid molecules targeted to different genes, enzymatic nucleic acid molecules coupled with known small molecule inhibitors, or intermittent treatment with combinations of enzymatic nucleic acid molecules (including different enzymatic nucleic acid molecule motifs) and/or other chemical or biological molecules). The treatment of subjects with nucleic acid molecules can also include combinations of different types of nucleic acid molecules. Therapies can be devised which include a mixture of enzymatic nucleic acid molecules (including different enzymatic nucleic acid molecule motifs), antisense and/or 2–5A chimera molecules to one or more targets to alleviate symptoms of a disease.

Administration of Nucleic Acid Molecules

Methods for the delivery of nucleic acid molecules are described in Akhtar et al., 1992, *Trends Cell Bio.*, 2, 139; and *Delivery Strategies for Antisense Oligonucleotide Therapeutics*, ed. Akhtar, 1995 which are both incorporated herein by reference. Sullivan et al., PCT WO 94/02595, further describes the general methods for delivery of enzymatic RNA molecules. These protocols can be utilized for the delivery of virtually any nucleic acid molecule. Nucleic acid molecules can be administered to cells by a variety of methods known to those familiar to the art, including, but not restricted to, encapsulation in liposomes, by iontophoresis, or by a incorporation into other vehicles, such as hydrogels, cyclodextrins, biodegradable nanocapsules, and bioadhesive microspheres. Alternatively, the nucleic acid/vehicle combination is locally delivered by direct injection or by use of an infusion pump. Other routes of delivery include, but are not limited to oral (tablet or pill form) and/or intrathecal delivery (Gold, 1997, *Neuroscience*, 76, 1153–1158). Other approaches include the use of various transport and carrier systems, for example, through the use of conjugates and biodegradable polymers. For a comprehensive review on drug delivery strategies including CNS delivery, see Ho et al., 1999, *Curr. Opin. Mol. Ther.*, 1, 336–343 and Jain, *Drug Delivery Systems: Technologies and Commercial Opportunities*, Decision Resources, 1998 and Groothuis et al., 1997, *J. NeuroVirol.*, 3, 387–400. More detailed descriptions of nucleic acid delivery and administration are provided in Sullivan et al., supra, Draper et al., PCT WO93/23569, Beigelman et al., PCT WO99/05094, and Klimuk et al., PCT WO99/04819 all of which have been incorporated by reference herein.

The molecules of the instant invention can be used as pharmaceutical agents. Pharmaceutical agents prevent, inhibit the occurrence, or treat (alleviate a symptom to some extent, preferably all of the symptoms) of a disease state in a subject.

The negatively charged polynucleotides of the invention can be administered (e.g., RNA, DNA or protein) and introduced into a subject by any standard means, with or without stabilizers, buffers, and the like, to form a pharmaceutical composition. When it is desired to use a liposome delivery mechanism, standard protocols for formation of liposomes can be followed. The compositions of the present invention can also be formulated and used as tablets, capsules or elixirs for oral administration; suppositories for rectal administration; sterile solutions; suspensions for injectable administration; and the other compositions known in the art.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic administration, into a cell or subject, preferably a human. Suitable forms, in part, depend upon the use or the route of entry, for example oral, transdermal, or by injection. Such forms should not prevent the composition or formulation from reaching a target cell (i.e., a cell to which the negatively charged polymer is desired to be delivered to). For example, pharmacological compositions injected into the blood stream should be soluble. Other factors are known in the art, and include considerations such as toxicity and forms which prevent the composition or formulation from exerting its effect.

By "systemic administration" is meant in vivo systemic absorption or accumulation of drugs in the blood stream followed by distribution throughout the entire body. Administration routes which lead to systemic absorption include, without limitations: intravenous, subcutaneous, intraperitoneal, inhalation, oral, intrapulmonary and intramuscular. Each of these administration routes expose the desired negatively charged polymers, e.g., nucleic acids, to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation which can facilitate the association of drug with the surface of cells, such as, lymphocytes and macrophages is also useful. This approach can provide enhanced delivery of the drug to target cells by taking advantage of the specificity of macrophage and lymphocyte immune recognition of abnormal cells, such as cancer cells.

By pharmaceutically acceptable formulation is meant, a composition or formulation that allows for the effective distribution of the nucleic acid molecules of the instant invention in the physical location most suitable for their desired activity. Non-limiting examples of agents suitable for formulation with the nucleic acid molecules of the instant invention include: PEG conjugated nucleic acids, phospholipid conjugated nucleic acids, nucleic acids containing lipophilic moieties, phosphorothioates, P-glycoprotein inhibitors (such as Pluronic P85) which can enhance entry of drugs into various tissues, for example the CNS (Jolliet-Riant and Tillement, 1999, *Fundam. Clin. Pharmacol.*, 13, 16–26); biodegradable polymers, such as poly (DL-lactide-coglycolide) microspheres for sustained release delivery after implantation (Emerich, DF et al, 1999, *Cell Transplant*, 8, 47–58) Alkermes, Inc. Cambridge, Mass.; and loaded nanoparticles, such as those made of polybutylcyanoacrylate, which can deliver drugs across the blood brain barrier and can alter neuronal uptake mechanisms (*Prog Neuropsychopharmacol Biol Psychiatry*, 23, 941–949, 1999). Other non-limiting examples of delivery strategies, including CNS delivery of the nucleic acid molecules of the instant invention include material described in Boado et al., 1998, *J. Pharm. Sci.*, 87, 1308–1315; Tyler et al, 1999, *FEBS Lett.*, 421, 280–284; Pardridge et al., 1995, *PNAS*

USA., 92, 5592–5596; Boado, 1995, *Adv. Drug Delivery Rev.*, 15, 73–107; Aldrian-Herrada et al., 1998, *Nucleic Acids Res.*, 26, 4910–4916; and Tyler et al., 1999, *PNAS USA.*, 96, 7053–7058. All these references are hereby incorporated herein by reference.

The invention also features the use of the composition comprising surface-modified liposomes containing poly (ethylene glycol) lipids (PEG-modified, or long-circulating liposomes or stealth liposomes). Nucleic acid molecules of the invention can also comprise covalently attached PEG molecules of various molecular weights. These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601–2627; Ishiwata et al., *Chem. Pharm. Bull.* 1995, 43, 1005–1011). Such liposomes have been shown to accumulate selectively in tumors, presumably by extravasation and capture in the neovascularized target tissues (Lasic et al., *Science* 1995, 267, 1275–1276; Oku et al., 1995, *Biochim. Biophys. Acta*, 1238, 86–90). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864–24870; Choi et al., International PCT Publication No. WO 96/10391; Ansell et al., International PCT Publication No. WO 96/10390; Holland et al., International PCT Publication No. WO 96/10392; all of which are incorporated by reference herein). Long-circulating liposomes are also likely to protect drugs from nuclease degradation to a greater extent compared to cationic liposomes, based on their ability to avoid accumulation in metabolically aggressive MPS tissues such as the liver and spleen. All of these references are incorporated by reference herein.

The present invention also includes compositions prepared for storage or administration which include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985) hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors which those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray or rectally in dosage unit formulations containing conventional non-toxic pharmaceutically acceptable carriers, adjuvants and vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be for example, inert diluents, such as calcium carbonate, sodium carbonate, lactose, calcium phosphate or sodium phosphate; granulating and disintegrating agents, for example, corn starch, or alginic acid; binding agents, for example starch, gelatin or acacia, and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in admixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid.

Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose any bland fixed oil can be employed including synthetic mono-or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per patient or subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular patient or subject depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

Alternatively, certain of the nucleic acid molecules of the instant invention can be expressed within cells from eukaryotic promoters (e.g., Izant and Weintraub, 1985, *Science*, 229, 345; McGarry and Lindquist, 1986, *Proc. Natl. Acad. Sci., USA* 83, 399; Scanlon et al., 1991, *Proc. Natl. Acad. Sci. USA*, 88, 10591–5; Kashani-Sabet et al., 1992, *Antisense Res. Dev.*, 2, 3–15; Dropulic et al., 1992, *J. Virol.*, 66, 1432–41; Weerasinghe et al., 1991, *J. Virol.*, 65, 5531–4; Ojwang et al., 1992, *Proc. Natl. Acad. Sci. USA*, 89, 10802–6; Chen et al., 1992, *Nucleic Acids Res.*, 20, 4581–9; Sarver et al., 1990 *Science*, 247, 1222–1225; Thompson et al, 1995, *Nucleic Acids Res.*, 23, 2259; Good et al., 1997, *Gene Therapy*, 4, 45; all of these references are hereby incorporated in their totalities by reference herein). Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, *Nucleic Acids Symp. Ser.*, 27, 15–6; Taira et al., 1991, *Nucleic Acids Res.*, 19, 5125–30; Ventura et al., 1993, *Nucleic Acids Res.*, 21, 3249–55; Chowrira et al., 1994, *J. Biol. Chem.*, 269, 25856; all of these references are hereby incorporated in their totalities by reference herein). Gene therapy approaches specific to the CNS are described by Blesch et al., 2000, *Drug News Perspect.*, 13, 269–280; Peterson et al., 2000, *Cent. Nerv. Syst. Dis.*, 485–508; Peel and Klein, 2000, *J. Neurosci. Methods*, 98, 95–104; Hagihara et al., 2000, *Gene Ther.*, 7, 759–763; and Herrlinger et al., 2000, *Methods Mol. Med.*, 35, 287–312. AAV-mediated delivery of nucleic acid to cells of the nervous system is further described by Kaplitt et al., U.S. Pat. No. 6,180,613.

In another aspect of the invention, RNA molecules of the present invention are preferably expressed from transcription units (see for example Couture et al., 1996, *TIG.*, 12, 510) inserted into DNA or RNA vectors. The recombinant vectors are preferably DNA plasmids or viral vectors. Ribozyme expressing viral vectors can be constructed based on, but not limited to, adeno-associated virus, retrovirus, adenovirus, or alphavirus. Preferably, the recombinant vectors capable of expressing the nucleic acid molecules are delivered as described above, and persist in target cells. Alternatively, viral vectors can be used that provide for transient expression of nucleic acid molecules. Such vectors can be repeatedly administered as necessary. Once expressed, the nucleic acid molecule binds to the target mRNA. Delivery of nucleic acid molecule expressing vectors can be systemic, such as by intravenous or intramuscular administration, by administration to target cells explanted from the patient or subject followed by reintroduction into the patient or subject, or by any other means that would allow for introduction into the desired target cell (for a review see Couture et al., 1996, *TIG.*, 12, 510).

In one aspect the invention features an expression vector comprising a nucleic acid sequence encoding at least one of the nucleic acid molecules of the instant invention is disclosed. The nucleic acid sequence encoding the nucleic acid molecule of the instant invention is operably linked in a manner which allows expression of that nucleic acid molecule.

In another aspect the invention features an expression vector comprising: a) a transcription initiation region (e.g., eukaryotic pol I, II or III initiation region); b) a transcription termination region (e.g., eukaryotic pol I, II or III termination region); c) a nucleic acid sequence encoding at least one of the nucleic acid catalyst of the instant invention; and wherein said sequence is operably linked to said initiation region and said termination region, in a manner which allows expression and/or delivery of said nucleic acid molecule. The vector can optionally include an open reading frame (ORF) for a protein operably linked on the 5' side or the 3'-side of the sequence encoding the nucleic acid catalyst of the invention; and/or an intron (intervening sequences).

Transcription of the nucleic acid molecule sequences are driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, *Proc. Natl. Acad. Sci. USA*, 87, 6743–7; Gao and Huang 1993, *Nucleic Acids Res.*, 21, 2867–72; Lieber et al., 1993, *Methods Enzymol.*, 217, 47–66; Zhou et al., 1990, *Mol. Cell. Biol.*, 10, 4529–37). All of these references are incorporated by reference herein. Several investigators have demonstrated that nucleic acid molecules, such as ribozymes expressed from such promoters can function in mammalian cells (e.g. Kashani-Sabet et al., 1992, *Antisense Res. Dev.*, 2, 3–15; Ojwang et al., 1992, *Proc. Natl. Acad. Sci. USA*, 89, 10802–6; Chen et al, 1992, *Nucleic Acids Res.*, 20, 4581–9; Yu et al., 1993, *Proc. Natl. Acad. Sci. USA*, 90, 6340–4; L'Huillier et al., 1992, *EMBO J.*, 11, 4411–8; Lisziewicz et al., 1993, *Proc. Natl. Acad. Sci. U.S.A*, 90, 8000–4; Thompson et al., 1995, *Nucleic Acids Res.*, 23, 2259; Sullenger & Cech, 1993, *Science*, 262, 1566). More specifically, transcription units such as the ones derived from genes encoding U6 small nuclear (snRNA), transfer RNA (tRNA) and adenovirus VA RNA are useful in generating high concentrations of desired RNA molecules such as ribozymes in cells (Thompson et al., supra; Couture and Stinchcomb, 1996, supra; Noonberg et al., 1994, *Nucleic Acid Res.*, 22, 2830; Noonberg et al., U.S. Pat. No. 5,624,803; Good et al., 1997, *Gene Ther.*, 4, 45; Beigelman et al., International PCT Publication No. WO 96/18736; all of these publications are incorporated by reference herein. The above ribozyme transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In another aspect the invention features an expression vector comprising nucleic acid sequence encoding at least one of the nucleic acid molecules of the invention, in a manner which allows expression of that nucleic acid molecule. The expression vector comprises in one embodiment; a) a transcription initiation region; b) a transcription termination region; c) a nucleic acid sequence encoding at least one said nucleic acid molecule; and wherein said sequence is operably linked to said initiation region and said termination region, in a manner which allows expression and/or delivery of said nucleic acid molecule.

In another embodiment the expression vector comprises: a) a transcription initiation region; b) a transcription termination region; c) an open reading frame; d) a nucleic acid sequence encoding at least one said nucleic acid molecule, wherein said sequence is operably linked to the 3'-end of said open reading frame; and wherein said sequence is operably linked to said initiation region, said open reading frame and said termination region, in a manner which allows expression and/or delivery of said nucleic acid molecule. In yet another embodiment the expression vector comprises: a) a transcription initiation region; b) a transcription termination region; c) an intron; d) a nucleic acid sequence encoding at least one said nucleic acid molecule; and wherein said sequence is operably linked to said initiation region, said intron and said termination region, in a manner which allows expression and/or delivery of said nucleic acid molecule.

In another embodiment, the expression vector comprises: a) a transcription initiation region; b) a transcription termination region; c) an intron; d) an open reading frame; e) a nucleic acid sequence encoding at least one said nucleic acid molecule, wherein said sequence is operably linked to the 3'-end of said open reading frame; and wherein said sequence is operably linked to said initiation region, said intron, said open reading frame and said termination region, in a manner which allows expression and/or delivery of said nucleic acid molecule.

EXAMPLES

The following are non-limiting examples showing the selection, isolation, synthesis and activity of nucleic acids of the instant invention.

The following examples demonstrate the selection and design of Antisense, hammerhead, DNAzyme, NCH, Amberzyme, Zinzyme, or G-Cleaver ribozyme molecules and binding/cleavage sites within IKK-gamma or PKR RNA.

Example 1

Identification of Potential Target Sites in Human IKK-Gamma and PKR RNA

The sequence of human IKK-gamma or PKR genes are screened for accessible sites using a computer-folding algorithm. Regions of the RNA that do not form secondary folding structures and contained potential enzymatic nucleic acid molecule and/or antisense binding/cleavage sites are identified. The sequences of these binding/cleavage sites are shown in Tables III–XIII.

Example 2

Selection of Enzymatic Nucleic Acid Cleavage Sites in Human IKK-Gamma and PKR RNA Enzymatic nucleic acid molecule target sites are chosen by analyzing sequences of Human IKK-gamma (Genbank accession No: NM_003639) (SEQ ID NO:8014) and PKR (Genbank accession No: NM_002759) and prioritizing the sites on the basis of folding. Enzymatic nucleic acid molecules are designed that can bind each target and are individually analyzed by computer folding (Christoffersen et al., 19941 Mol. Struc. Theochern, 311, 273; Jaeger et al., 1989, Proc. Natl. Acad. Sci. USA, 86, 7706) to assess whether the enzymatic nucleic acid molecule sequences fold into the appropriate secondary structure. Those enzymatic nucleic acid molecules with unfavorable intramolecular interactions between the binding arms and the catalytic core were eliminated from consideration. As noted below, varying binding arm lengths can be chosen to optimize activity. Generally, at least 5 bases on each arm are able to bind to, or otherwise interact with, the target RNA.

Example 3

Chemical Synthesis and Purification of Ribozymes and Antisense for Efficient Cleavage and/or Blocking of IKK-Gamma and PKR RNA Enzymatic nucleic acid molecules and antisense constructs are designed to anneal to various sites in the RNA message. The binding arms of the enzymatic nucleic acid molecules are complementary to the target site sequences described above, while the antisense constructs are fully complementary to the target site sequences described above. The enzymatic nucleic acid molecules and antisense constructs were chemically synthesized. The method of synthesis used followed the procedure for normal RNA synthesis as described above and in Usman et al., (1987 J. Am. Chem. Soc., 109, 7845), Scaringe et al., (1990 Nucleic Acids Res., 18, 5433) and Wincott et al., supra, and made use of common nucleic acid protecting and coupling groups, such as dimetboxytrityl at the 5'-end, and phosphoramidites at the 3'-end. The average stepwise coupling yields were typically >98%.

Enzymatic nucleic acid molecules and antisense constructs are also synthesized from DNA templates using bacteriophage T7 RNA polymerase (Milligan and Uhlenbeck, 1989, Methods Enzymol. 180, 51). Enzymatic nucleic acid molecules and antisense constructs are purified by gel electrophoresis using general methods or are purified by high pressure liquid chromatography (HPLC; See Wincott et al., supra; the totality of which is hereby incorporated herein by reference) and are resuspended in water. The sequences of the chemically synthesized enzymatic nucleic acid molecules used in this study are shown below in Table XIII. The sequences of the chemically synthesized antisense constructs used in this study are complementary sequences to the Substrate sequences shown below as in Tables III to XIII.

Example 4

Enzymatic Nucleic Acid Molecule Cleavage of IKK-Gamma and PKR RNA Target In Vitro Enzymatic nucleic acid molecules targeted to the human IKK-gamma or PKR RNA are designed and synthesized as described above. These enzymatic nucleic acid molecules can be tested for cleavage activity in vitro, for example, using the following procedure. The target sequences and the nucleotide location within the IKK-gamma or PKR RNA are given in Tables III–XIII.

Cleavage Reactions: Full-length or partially full-length, internally-labeled target RNA for enzymatic nucleic acid molecule cleavage assay is prepared by in vitro transcription in the presence of [a-$^{32}$P] CTP, passed over a G 50 Sephadex column by spin chromatography and used as substrate RNA without further purification. Alternately, substrates are 5'-$^{32}$P-end labeled using T4 polynucleotide kinase enzyme. Assays are performed by pre-warming a 2× concentration of purified enzymatic nucleic acid molecule in enzymatic nucleic acid molecule cleavage buffer (50 mM Tris-HCl, pH 7.5 at 37° C., 10 mM MgCl$_2$) and the cleavage reaction was initiated by adding the 2× enzymatic nucleic acid molecule mix to an equal volume of substrate RNA (maximum of 1–5 nM) that was also pre-warmed in cleavage buffer. As an initial screen, assays are carried out for 1 hour at 37° C. using a final concentration of either 40 nM or 1 mM enzymatic nucleic acid molecule, i.e., enzymatic nucleic acid molecule excess. The reaction is quenched by the addition of an equal volume of 95% formamide, 20 mM EDTA, 0.05% bromophenol blue and 0.05% xylene cyanol after which the sample is heated to 95° C. for 2 minutes, quick chilled and loaded onto a denaturing polyacrylamide gel. Substrate RNA and the specific RNA cleavage products generated by enzymatic nucleic acid molecule cleavage are visualized on an autoradiograph of the gel. The percentage of cleavage is determined by Phosphor Imager® quantitation of bands representing the intact substrate and the cleavage products.

Example 5

Nucleic Acid Down-Regulation of IKK-Gamma and PKR Target RNA In Vivo

Nucleic acid molecules targeted to the human IKK-gamma or PKR RNA are designed and synthesized as described above. These nucleic acid molecules can be tested for cleavage activity in vivo, for example using the procedures described below. The target sequences and the nucleotide location within the IKK-gamma or PKR RNA are given in Tables III–XIII.

Example 6

In Vivo Models Used to Evaluate the Down-Regulation of IKK-Gamma or PKR Gene Expression A variety of endpoints have been used in cell culture models to evaluate IKK-gamma or PKR-mediated effects after treatment with anti-IKK-gamma or PKR agents. Phenotypic endpoints include inhibition of cell proliferation, apoptosis assays and reduction of IKK-gamma or PKR protein expression, or a decrease in NFKB expression. Since IKK-gamma and PKR are both involved in the induction of NFKB, NFKB can be used as a surrogate marker in cell culture, animal, and clinical studies. Because overexpression of NFKB is directly associated with increased proliferation of tumor cells, a proliferation endpoint for cell culture assays is preferably used as a primary screen. There are several methods by which this endpoint can be measured. Following treatment of cells with nucleic acid molecules, cells are allowed to grow (typically 5 days) after which either the cell viability, the incorporation of [$^3$H] thymidine into cellular DNA and/or the cell density can be measured. The assay of cell density is very straightforward and can be performed in a 96-well format using commercially available fluorescent nucleic acid stains (such as Syto® 13 or CyQuant®). An assay using CyQuant® is described herein.

As a secondary, confirmatory endpoint a nucleic acid-mediated decrease in the level of IKK-gamma or PKR RNA and/or IKK-gamma or PKR protein expression can be evaluated. Alternately, a decrease in the level of NFKB RNA can be evaluated.

Cell Culture

Cell types that express/over-express NFKB include HeLa, macrophages, peripheral blood lymphocytes, hepatocytes, fibroblasts, endothelial cells and epithelial cells. In culture, these cells can be stimulated to express/over-express NFKB by addition of TNF-alpha PMA or IL-1-beta to the culture medium. Some of these cell types also can respond with a similar activation of NFKB following LPS treatment. Activation of NFKB in cultured cells can be evaluated by electrophoretic mobility shift assay (EMSA). Delineation of alterations in the subunits can be determined by Western blot.

Primary Screen

A useful cell culture system in evaluating NFKB modulation is human colonic epithelial cells. One suitable cell line is SW620 colon carcinoma cells (CCL227). These cells respond to stimulation with TNF-alpha, LPS and/or IL-1-beta with an increase in NFKB activation. SW620 cells are grown in MEM supplemented with 10% heat-inactivated FBS and glutamine (2 mmol/L).

TNF-alpha dose-response curves in these cells are determined by incubating cells with various concentrations of recombinant human TNF-alpha (Sigma Chemical Co.). Maximal DNA binding activity induction can occur with 150 U/ml TNF-alpha in the culture medium. Induction is typically evident within 10 minutes of treatment with TNF-alpha reaches a peak at one hour post-treatment and persists for up to 4 hours post-treatment. The primary readout can be NFKB DNA activity in nuclear extracts of SW620 cells as determined by electrophoretic mobility shift assays (EMSA). Once the appropriate TNF-alpha dose/response profile has been determined, inhibition of IKK-gamma, PKR, or NFKB activation is evaluated using specific and non-specific inhibitors of activation, sulfasalazine and steroids, respectively. Cells are incubated with inhibitors or control media for 30 minutes prior to stimulation with TNF-alpha Nuclear extracts are prepared and evaluated for DNA binding activity by EMSA. Once the activity of positive controls has been established, enzymatic nucleic acids targeting the IKK-gamma or PKR are evaluated in this system. Supershift assays using polyclonal antibodies against the NFKB or PKR protein subunits can be performed to confirm down-regulation of NFKB.

Secondary Screens

SW620 cells can be transfected with the 3×Ig-kappa-B-Luc reporter construct 18 hours before challenge with TNF-alpha, LPS or PMA. The readout for this assay is luciferase activity. Test compounds are applied 17.5 hours after transfection (30 minutes before challenge). Cells are harvested 24 hours after challenge and relative changes in luciferase activity is used as the endpoint. Lastly, the activation of NFKB can be visualized fluorescently. Inactive NFKB heterodimers are held in the cytoplasm by inhibitory proteins. Once activated, the free heterodimers translocate to the nucleus. Thus, the relative change in cytoplasmic versus nuclear fluorescence can indicate the degree of NFKB activation. Cells can be grown on chamber slides, treated with TNF-alpha with and without test compounds), and the location of the NFKB subunit can be determined by immunofluorescence using a FITC-labeled antibody to NFKB.

Animal Models

Evaluating the efficacy of anti-IKK-gamma or PKR agents in animal models is an important prerequisite to human clinical trials. Studies have shown that human breast carcinoma cell lines express high levels of NFKB (Sovak et al., 1997, *J. Clin. Invest.*, 100, 2952–2960). High levels of NFKB have also been observed in carcinogen-induced primary rat mammary tumors and in human breast cancer specimins. Additionally, HER2/neu overexpression has been shown to activate NFKB (Pianetti et al., 2001, *Oncogene*, 20, 1287–1299). As such, xenografts of cell lines that over-express NFKB can be used in animal models of tumorigenesis and/or inflammation to study the inhibition of NFKB.

Oncology Animal Model Development

Tumor cell lines are characterized to establish their growth curves in mice. These cell lines are implanted into both nude and SCID mice and primary tumor volumes are measured 3 times per week. Growth characteristics of these tumor lines using a Matrigel implantation format can also be established. The use of other cell lines that have been engineered to express high levels of NFKB can also be used in the described studies. The tumor cell line(s) and implantation method that supports the most consistent and reliable tumor growth is used in animal studies testing the lead IKK-gamma or PKR nucleic acid(s). Nucleic acids are administered by daily subcutaneous injection or by continuous subcutaneous infusion from Alzet mini osmotic pumps beginning 3 days after tumor implantation and continuing for the duration of the study. Group sizes of at least 10 animals are employed. Efficacy is determined by statistical comparison of tumor volume of nucleic acid-treated animals to a control group of animals treated with saline alone. Because the growth of these tumors is generally slow (45–60 days), an initial endpoint is the time in days it takes to establish an easily measurable primary tumor (i.e. 50–100 mm$^3$) in the presence or absence of nucleic acid treatment.

Inflammation Animal Model Development

Chronic, sublethal administration of indomethacin to outbred rats produces an enteropathy characterized by thickening of the small intestine and mesentery, ulcerations, granulomatous inflammation, crypt abcesses and adhesions. These lesions are similar to those that are characteristic findings in human patients with Crohn's disease (CD). Thus, any beneficial therapeutic effects revealed using this model can be extrapolated to potential benefit for patients with CD.

Male Sprague-Dawley rats (200–275 g) are utilized for these studies. Chronic intestinal inflammation is induced by two subcutaneous injections of indomethacin (7.5 mg/kg in 5% NaHCO3) administered on subsequent days (Day-0 and Day-1). Animals are followed for four days following the first indomethacin injection. The mortality rate associated with this model is typically less than 10%. On the last day of the study, animals are euthanized by CO$_2$ asphyxiation, small intestines excised and gross pathologic findings ranked according to the following criteria: 0, normal ; 1, minimal abnormalities, slight thickening of the small intestine, no adhesions; 2, obvious thickening of small intestine with 1 adhesion; 3, obvious thickening of small intestine with 2 or 3 adhesions; 4, massive adhesions to the extent that the intestine cannot be separated, contents primarily fluid; 5, severe peritonitis resulting in death. A 10-cm portion of the most affected region of the small intestine is weighed, placed in 10% neutral buffered formalin and submitted for histopathologic evaluation.

The 10 cm portion of gut from each animal is cut into five equal sections. Transverse and longitudinal sections of each portion are cut and stained with hematoxylin and eosin. All slides are read in a blinded fashion and each section is scored for necrosis (% area of involvement) and inflammatory response according to the following scale:

Necrosis—1, 10%; 2, 10–25%; 3, 25–50%; 4, 50–75%; 5, 75–100%;

Inflammation—
1=minimal in mesentery and muscle or lesion
2=mild in mesentery and muscle or lesion
3=moderate in mesentery and muscle or lesion
4=marked in lesion
5=severe in lesion The scores for each of the five sections are averaged for necrosis and for inflammation.

NFKB Levels for Patient Screening and as a Potential Endpoint

Because elevated NFKB levels can be detected in cancers, cancer patients can be pre-screened for elevated NFKB prior to admission to initial clinical trials testing an anti-IKK-gamma or PKR nucleic acid. Initial NFKB levels can be determined (by ELISA) from tumor biopsies or resected tumor samples. During clinical trials, it can be possible to monitor circulating NFKB protein by ELISA. Evaluation of serial blood/serum samples over the course of the anti-IKK-gamma or PKR nucleic acid treatment period could be useful in determining early indications of efficacy.

Example 7

Activity of Nucleic Acid Molecules Used to Down-Regulate IKK-Gamma and PKR Gene Expression Several nucleic acid molecules targeted against IKK-gamma or PKR RNA have been designed and synthesized. These nucleic acid molecules can be tested in cell proliferation and RNA reduction assays described herein.

Proliferation Assay

The model proliferation assay used in the study requires a cell-plating density of 2,000–10,000 cells/well in 96-well plates and at least 2 cell doublings over a 5-day treatment period. Cells used in proliferation studies were either lung or ovarian cancer cells (A549 and SKOV-3 cells respectively). To calculate cell density for proliferation assays, the FIPS (fluoro-imaging processing system) method known in the art was used. This method allows for cell density measurements after nucleic acids are stained with CyQuant® dye, and has the advantage of accurately measuring cell densities over a very wide range 1,000–100,000 cells/well in 96-well format. Enzymatic nucleic acid molecules (50–200 nM) are delivered in the presence of cationic lipid at 2.5–5.0 µg/nL and inhibition of proliferation was determined on day 5 post-treatment.

RNA Assay

RNA is harvested 24 hours post-treatment using the Qiagen RNeasy® 96 procedure. Real time RT-PCR (Taq-Man® assay) is performed on purified RNA samples using separate primer/probe sets specific for target IKK-gamma or PKR RNA.

Indications

Particular degenerative and disease states that can be associated with IKK-gamma or PKR expression modulation include but are not limited to cancerous and/or inflammatory diseases and conditions such as breast, lung, prostate, colorectal, brain, esophageal, bladder, pancreatic, cervical, head and neck, and ovarian cancer, melanoma, lymphoma, glioma, multidrug resistant cancers, rheumatoid arthritis, restenosis, asthma, Crohn's disease, diabetes, obesity, autoimmune disease, lupus, multiple sclerosis, transplant/graft rejection, gene therapy applications, ischemia/reperfusion injury (CNS and myocardial), glomerulonephritis, sepsis, allergic airway inflammation, inflammatory bowel disease, infection, incontinentia pigmenti and any other diseases or conditions that are related to or respond to the levels of IKK-gamma or PKR in a cell or tissue. The present body of knowledge in IKI-gamma and PKR research indicates the need for methods to assay IKK-gamma and PKR activity and for compounds that can regulate IKK-gamma and PKR expression for research, diagnostic, and therapeutic use.

The use of monoclonal antibodies, chemotherapy, radiation therapy, analgesics, and/or anti-inflammatory compounds, are all non-limiting examples of a methods that can be combined with or used in conjunction with the nucleic acid molecules (e.g. ribozymes and antisense molecules) of the instant invention. Common chemotherapies that can be combined with nucleic acid molecules of the instant invention include various combinations of cytotoxic drugs to kill cancer cells. These drugs include but are not limited to paclitaxel (Taxol), docetaxel, cisplatin, methotrexate, cyclophosphamide, doxorubin, fluorouracil carboplatin, edatrexate, gemcitabine, vinorelbine etc. Those skilled in the art will recognize that other drug compounds and therapies can be similarly be readily combined with the nucleic acid molecules of the instant invention (e.g. ribozymes and antisense molecules) are hence within the scope of the instant invention.

Diagnostic Uses

The nucleic acid molecules of this invention (e.g., enzymatic nucleic acid molecules) can be used as diagnostic tools to examine genetic drift and mutations within diseased cells or to detect the presence of IKK-gamma or PKR RNA in a cell. The close relationship between enzymatic nucleic acid molecule activity and the structure of the target RNA allows the detection of mutations in any region of the molecule which alters the base-pairing and three-dimensional structure of the target RNA. By using multiple enzymatic nucleic acid molecules described in this invention, one can map nucleotide changes which are important to RNA structure and function in vitro, as well as in cells and tissues. Cleavage of target RNAs with enzymatic nucleic acid molecules can be used to inhibit gene expression and define the role (essentially) of specified gene products in the progression of disease. In this manner, other genetic targets can be defined as important mediators of the disease. These experiments can lead to better treatment of the disease progression by affording the possibility of combinational therapies (e.g., multiple enzymatic nucleic acid molecules targeted to different genes, enzymatic nucleic acid molecules coupled with known small molecule inhibitors, or intermittent treatment with combinations of enzymatic nucleic acid molecules and/or other chemical or biological molecules).

Other in vitro uses of enzymatic nucleic acid molecules of this invention are well known in the art, and include detection of the presence of mRNAs associated with IKK-gamma or PKR-related condition. Such RNA is detected by determining the presence of a cleavage product after treatment with an enzymatic nucleic acid molecule using standard methodology.

In a specific example, enzymatic nucleic acid molecules which cleave only wild-type or mutant forms of the target RNA are used for the assay. The first enzymatic nucleic acid molecule is used to identify wild-type RNA present in the sample and the second enzymatic nucleic acid molecule is used to identify mutant RNA in the sample. As reaction controls, synthetic substrates of both wild-type and mutant RNA are cleaved by both enzymatic nucleic acid molecules to demonstrate the relative enzymatic nucleic acid molecule efficiencies in the reactions and the absence of cleavage of the "non-targeted" RNA species. The cleavage products from the synthetic substrates also serve to generate size markers for the analysis of wild-type and mutant RNAs in the sample population. Thus each analysis requires two enzymatic nucleic acid molecules, two substrates and one unknown sample which is combined into six reactions. The presence of cleavage products is determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., IKK-gamma or PKR) is adequate to establish risk. If probes of comparable specific activity are used for both transcripts, then a qualitative comparison of RNA levels will be adequate and will decrease the cost of the initial diagnosis. Higher mutant form to wild-type ratios are correlated with higher risk whether RNA levels are compared qualitatively or quantitatively. The use of enzymatic nucleic acid molecules in diagnostic applications contemplated by the instant invention is more fully described in George et al., U.S. Pat. Nos. 5,834,186 and 5,741,679, Shih et al., U.S. Pat. No. 5,589,332, Nathan et al., U.S. Pat. No. 5,871,914, Nathan and Ellington, International PCT publication No. WO 00/24931, Breaker et al., International PCT Publication Nos. WO 00/26226 and 98/27104, and Sullenger et al., International PCT publication No. WO 99/29842.

Additional Uses

Potential uses of sequence-specific enzymatic nucleic acid molecules of the instant invention can have many of the same applications for the study of RNA that DNA restriction endonucleases have for the study of DNA (Nathans et al., 1975 *Ann. Rev. Biochem.* 44:273). For example, the pattern of restriction fragments can be used to establish sequence relationships between two related RNAs, and large RNAs can be specifically cleaved to fragments of a size more useful for study. The ability to engineer sequence specificity of the enzymatic nucleic acid molecule is ideal for cleavage of RNAs of unknown sequence. Applicant has described the use of nucleic acid molecules to down-regulate gene expression of target genes in bacterial, microbial, fungal, viral, and eukaryotic systems including plant, or mammalian cells.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims.

The invention illustratively described herein suitably can be practiced in the absence of any element or elements, limitation or limitations which is not specifically disclosed herein. Thus, for example, in each instance herein any of the terms "comprising", "consisting essentially of" and "consisting of" can be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed can be restored to by tose skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group1

Other embodiments are within the claims that follow.

TABLE I

Characteristics of naturally occurring ribozymes

Group I Introns

Size: ~150 to >1000 nucleotides.
Requires a U in the target sequence immediately 5' of the cleavage site.
Binds 4–6 nucleotides at the 5'-side of the cleavage site.
Reaction mechanism: attack by the 3'-OH of guanosine to generate cleavage products with 3'-OH and 5'-guanosine.

TABLE I-continued

Characteristics of naturally occurring ribozymes

Additional protein cofactors required in some cases to help folding and maintenance of the active structure.
Over 300 known members of this class. Found as an intervening sequence in *Tetrahymena thermophila* rRNA, fungal mitochondria, chloroplasts, phage T4, blue-green algae, and others.
Major structural features largely established through phylogenetic comparisons, mutagenesis, and biochemical studies [i,ii].
Complete kinetic framework established for one ribozyme [iii,iv,v,vi].
Studies of ribozyme folding and substrate docking underway [vii,viii,ix].
Chemical modification investigation of important residues well established [x,xi].
The small (4–6 nt) binding site can make this ribozyme too non-specific for targeted RNA cleavage, however, the Tetrahymena group I intron has been used to repair a "defective" β-galactosidase message by the ligation of new β-galactosidase sequences onto the defective message [xii].

RNAse P RNA (M1 RNA)

Size: ~290 to 400 nucleotides.
RNA portion of a ubiquitous ribonucleoprotein enzyme.
Cleaves tRNA precursors to form mature tRNA [xiii].
Reaction mechanism: possible attack by $M^{2+}$-OH to generate cleavage products with 3'-OH and 5'-phosphate.
RNAse P is found throughout the prokaryotes and eukaryotes. The RNA subunit has been sequenced from bacteria, yeast, rodents, and primates.
Recruitment of endogenous RNAse P for therapeutic applications is possible through hybridization of an External Guide Sequence (EGS) to the target RNA [xiv,xv]
Important phosphate and 2' OH contacts recently identified [xvi,xvii]

Group II Introns

Size: >1000 nucleotides.
Trans cleavage of target RNAs recently demonstrated [xviii,xix].
Sequence requirements not fully determined.
Reaction mechanism: 2'-OH of an internal adenosine generates cleavage products with 3'-OH and a "lariat" RNA containing a 3'-5' and a 2'-5' branch point.
Only natural ribozyme with demonstrated participation in DNA cleavage [xx,xxi] in addition to RNA cleavage and ligation.
Major structural features largely established through phylogenetic comparisons [xxii].
Important 2'OH contacts beginning to be identified [xxiii]
Kinetic framework under development [xxiv]

Neurospora VS RNA

Size: ~144 nucleotides.
Trans cleavage of hairpin target RNAs recently demonstrated [xxv].
Sequence requirements not fully determined.
Reaction mechanism: attack by 2'-OH 5' to the scissile bond to generate cleavage products with 2',3'-cyclic phosphate and 5'-OH ends.
Binding sites and structural requirements not fully determined.
Only 1 known member of this class. Found in Neurospora VS RNA.

Hammerhead Ribozyme
(see text for references)

Size: ~13 to 40 nucleotides.
Requires the target sequence UH immediately 5' of the cleavage site.
Binds a variable number nucleotides on both sides of the cleavage site.
Reaction mechanism: attack by 2'-OH 5' to the scissile bond to generate cleavage products with 2',3'-cyclic phosphate and 5'-OH ends.
14 known members of this class. Found in a number of plant pathogens (virusoids) that use RNA as the infectious agent.
Essential structural features largely defined, including 2 crystal structures [xxvi,xxvii]
Minimal ligation activity demonstrated (for engineering through in vitro selection) [xxviii]
Complete kinetic framework established for two or more ribozymes [xxix].
Chemical modification investigation of important residues well established [xxx].

Hairpin Ribozyme

Size: ~50 nucleotides.
Requires the target sequence GUC immediately 3' of the cleavage site.
Binds 4–6 nucleotides at the 5'-side of the cleavage site and a variable number to the 3'-side of the cleavage site.
Reaction mechanism: attack by 2'-OH 5' to the scissile bond to generate cleavage products with 2',3'-cyclic phosphate and 5'-OH ends.
3 known members of this class. Found in three plant pathogen (satellite RNAs of the tobacco ringspot virus, arabis mosaic virus and chicory yellow mottle virus) which uses RNA as the infectious agent.
Essential structural features largely defined [xxxi,xxxii,xxxiii,xxxiv]
Ligation activity (in addition to cleavage activity) makes ribozyme amenable to

TABLE I-continued

Characteristics of naturally occurring ribozymes engineering through in vitro selection [xxxv]
Complete kinetic framework established for one ribozyme [xxxvi].
Chemical modification investigation of important residues begun [xxxvii,xxxviii].
Hepatitis Delta Virus (HDV) Ribozyme Size: ~60 nucleotides.
Trans cleavage of target RNAs demonstrated [xxxix].
Binding sites and structural requirements not fully determined, although no sequences 5' of cleavage site are required. Folded ribozyme contains a pseudoknot structure [xl].
Reaction mechanism: attack by 2'-OH 5' to the scissile bond to generate cleavage products with 2',3'-cyclic phosphate and 5'-OH ends.
Only 2 known members of this class. Found in human HDV.
Circular form of HDV is active and shows increased nuclease stability [xli]

---

[i]. Michel, Francois; Westhof, Eric. Slippery substrates. Nat. Struct. Biol. (1994), 1(1), 5–7.

[ii]. Lisacek, Frederique; Diaz, Yolande; Michel, Francois. Automatic identification of group I intron cores in genomic DNA sequences. J. Mol. Biol. (1994), 235(4), 1206–17.

[iii]. Herschlag, Daniel; Cech, Thomas R.. Catalysis of RNA cleavage by the *Tetrahymena thermophila* ribozyme. 1. Kinetic description of the reaction of an RNA substrate complementary to the active site. Biochemistry (1990), 29(44), 10159–71.

[iv]. Herschlag, Daniel; Cech, Thomas R.. Catalysis of RNA cleavage by the *Tetrahymena thermophila* ribozyme. 2. Kinetic description of the reaction of an RNA substrate that forms a mismatch at the active site. Biochemistry (1990), 29(44), 10172–80.

[v]. Knitt, Deborah S.; Herschlag, Daniel. pH Dependencies of the Tetrahymena Ribozyme Reveal an Unconventional Origin of an Apparent pKa. Biochemistry (1996), 35(5), 1560–70.

[vi]. Bevilacqua, Philip C.; Sugimoto, Naoki; Turner, Douglas H.. A mechanistic framework for the second step of splicing catalyzed by the Tetrahymena ribozyme. Biochemistry (1996), 35(2), 648–58.

[vii]. Li, Yi; Bevilacqua, Philip C.; Mathews, David; Turner, Douglas H.. Thermodynamic and activation parameters for binding of a pyrene-labeled substrate by the Tetrahymena ribozyme: docking is not diffusion-controlled and is driven by a favorable entropy change. Biochemistry (1995), 34(44), 14394–9.

[viii]. Banerjee, Aloke Raj; Turner, Douglas H.. The time dependence of chemical modification reveals slow steps in the folding of a group I ribozyme. Biochemistry (1995), 34(19), 6504–12.

[ix]. Zarrinkar, Patrick P.; Williamson, James R.. The P9.1–P9.2 peripheral extension helps guide folding of the Tetrahymena ribozyme. Nucleic Acids Res. (1996), 24(5), 854–8.

[x]. Strobel, Scott A.; Cech, Thomas R.. Minor groove recognition of the conserved G.cntdot.U pair at the Tetrahymena ribozyme reaction site. Science (Washington, D. C.) (1995), 267(5198), 675–9.

[xi]. Strobel, Scott A.; Cech, Thomas R.. Exocyclic Amine of the Conserved G.cntdot.U Pair at the Cleavage Site of the Tetrahymena Ribozyme Contributes to 5'-Splice Site Selection and Transition State Stabilization. Biochemistry (1996), 35(4), 1201–11.

[xii]. Sullenger, Bruce A.; Cech, Thomas R.. Ribozyme-mediated repair of defective mRNA by targeted trans-splicing. Nature (London) (1994), 371(6498), 619–22.

[xiii]. Robertson, H. D.; Altman, S.; Smith, J. D. J. Biol. Chem., 247, 5243–5251 (1972).

[xiv]. Forster, Anthony C.; Altman, Sidney. External guide sequences for an RNA enzyme. Science (Washington, D. C., 1883–) (1990), 249(4970), 783–6.

[xv]. Yuan, Y.; Hwang, E. S.; Altman, S. Targeted cleavage of mRNA by human RNase P. Proc. Natl. Acad. Sci. USA (1992) 89, 8006–10.

[xvi]. Harris, Michael E.; Pace, Norman R.. Identification of phosphates involved in catalysis by the ribozyme RNase P RNA. RNA (1995), 1(2), 210–18.

[xvii]. Pan, Tao; Loria, Andrew; Zhong, Kun. Probing of tertiary interactions in RNA: 2'-hydroxyl-base contacts between the RNase P RNA and pre-tRNA. Proc. Natl. Acad. Sci. U.S.A. (1995), 92(26), 12510–14.

[xviii]. Pyle, Anna Marie; Green, Justin B.. Building a Kinetic Framework for Group II Intron Ribozyme Activity: Quantitation of Interdomain Binding and Reaction Rate. Biochemistry (1994), 33(9), 2716–25.

[xix]. Michels, William J. Jr.; Pyle, Anna Marie. Conversion of a Group II Intron into a New Multiple-Turnover Ribozyme that Selectively Cleaves Oligonucleotides: Elucidation of Reaction Mechanism and Structure/Function Relationships. Biochemistry (1995), 34(9), 2965–77.

[xx]. Zimmerly, Steven; Guo, Huatao; Eskes, Robert; Yang, Jian; Perlman, Philip S.; Lambowitz, Alan M.. A group II intron RNA is a catalytic component of a DNA endonuclease involved in intron mobility. Cell (Cambridge, Mass.) (1995), 83(4), 529–38.

[xxi]. Griffin, Edmund A., Jr.; Qin, Zhifeng; Michels, Williams J., Jr.; Pyle, Anna Marie. Group II intron ribozymes that cleave DNA and RNA linkages with similar efficiency, and lack contacts with substrate 2'-hydroxyl groups. Chem. Biol. (1995), 2(11), 761–70.

[xxii]. Michel, Francois; Ferat, Jean Luc. Structure and activities of group II introns. Annu. Rev. Biochem. (1995), 64, 435–61.

[xxiii]. Abramovitz, Dana L.; Friedman, Richard A.; Pyle, Anna Marie. Catalytic role of 2'-hydroxyl groups within a group II intron active site. Science (Washington, D. C.) (1996), 271(5254), 1410–13.

[xxiv]. Daniels, Danette L.; Michels, William J., Jr.; Pyle, Anna Marie. Two competing pathways for self-splicing by group II introns: a quantitative analysis of in vitro reaction rates and products. J. Mol. Biol. (1996), 256(1), 31–49.

TABLE I-continued

Characteristics of naturally occurring ribozymes

[xxv]. Guo, Hans C. T.; Collins, Richard A.. Efficient trans-cleavage of a stem-loop RNA substrate by a ribozyme derived from Neurospora VS RNA. EMBO J. (1995), 14(2), 368–76.
[xxvi]. Scott, W. G., Finch, J. T., Aaron, K. The crystal structure of an all RNA hammerhead ribozyme: Aproposed mechanism for RNA catalytic cleavage. Cell, (1995), 81, 991–1002.
[xxvii]. McKay, Structure and function of the hammerhead ribozyme: an unfinished story. RNA, (1996), 2, 395–403.
[xxviii]. Long, D., Uhlenbeck, O., Hertel, K. Ligation with hammerhead ribozymes. U.S. Pat. No. 5,633,133.
[xxix]. Hertel, K. J., Herschlag, D., Uhlenbeck, O. A kinetic and thermodynamic framework for the hammerhead ribozyme reaction. Biochemistry, (1994) 33, 3374–3385. Beigelman, L., et al., Chemical modifications of hammerhead ribozymes. J. Biol. Chem., (1995) 270, 25702–25708.
[xxx]. Beigelman, L., et al., Chemical modifications of hammerhead ribozymes. J. Biol. Chem., (1995) 270, 25702–25708.
[xxxi]. Hampel, Arnold; Tritz, Richard; Hicks, Margaret; Cruz, Phillip. 'Hairpin' catalytic RNA model: evidence for helixes and sequence requirement for substrate RNA. Nucleic Acids Res. (1990), 18(2), 299–304.
[xxxii]. Chowrira, Bharat M.; Berzal-Herranz, Alfredo; Burke, John M.. Novel guanosine requirement for catalysis by the hairpin ribozyme. Nature (London) (1991), 354(6351), 320–2.
[xxxiii]. Berzal-Herranz, Alfredo; Joseph, Simpson; Chowrira, Bharat M.; Butcher, Samuel E.; Burke, John M.. Essential nucleotide sequences and secondary structure elements of the hairpin ribozyme. EMBO J. (1993), 12(6), 2567–73.
[xxxiv]. Joseph, Simpson; Berzal-Herranz, Alfredo; Chowrira, Bharat M.; Butcher, Samuel E.. Substrate selection rules for the hairpin ribozyme determined by in vitro selection, mutation, and analysis of mismatched substrates. Genes Dev. (1993), 7(1), 130–8.
[xxxv]. Berzal-Herranz, Alfredo; Joseph, Simpson; Burke, John M.. In vitro selection of active hairpin ribozymes by sequential RNA-catalyzed cleavage and ligation reactions. Genes Dev. (1992), 6(1), 129–34.
[xxxvi]. Hegg, Lisa A.; Fedor, Martha J.. Kinetics and Thermodynamics of Intermolecular Catalysis by Hairpin Ribozymes. Biochemistry (1995), 34(48), 15813–28.
[xxxvii]. Grasby, Jane A.; Mersmann, Karin; Singh, Mohinder; Gait, Michael J.. Purine Functional Groups in Essential Residues of the Hairpin Ribozyme Required for Catalytic Cleavage of RNA. Biochemistry (1995), 34(12), 4068–76.
[xxxviii]. Schmidt, Sabine; Beigelman, Leonid; Karpeisky, Alexander; Usman, Nassim; Sorensen, Ulrik S.; Gait, Michael J.. Base and sugar requirements for RNA cleavage of essential nucleoside residues in internal loop B of the hairpin ribozyme: implications for secondary structure. Nucleic Acids Res. (1996), 24(4), 573–81.
[xxxix]. Perrotta, Anne T.; Been, Michael D.. Cleavage of oligoribonucleotides by a ribozyme derived from the hepatitis .delta. virus RNA sequence. Biochemistry (1992), 31(1), 16–21.
[xl]. Perrotta, Anne T.; Been, Michael D.. A pseudoknot-like structure required for efficient self-cleavage of hepatitis delta virus RNA. Nature (London) (1991), 350(6317), 434–6.
[xli]. Puttaraju, M.; Perrotta, Anne T.; Been, Michael D.. A circular trans-acting hepatitis delta virus ribozyme. Nucleic Acids Res. (1993), 21(18), 4253–8.

TABLE II

| A. 2.5 µmol Synthesis Cycle ABI 394 Instrument | | | | | |
|---|---|---|---|---|---|
| Reagent | Equivalents | Amount | Wait Time* DNA | Wait Time* 2'-O-methyl | Wait Time*RNA |
| Phosphoramidites | 6.5 | 163 µL | 45 sec | 2.5 min | 7.5 min |
| S-Ethyl Tetrazole | 23.8 | 238 µL | 45 sec | 2.5 min | 7.5 min |
| Acetic Anhydride | 100 | 233 µL | 5 sec | 5 sec | 5 sec |
| N-Methyl Imidazole | 186 | 233 µL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 µL | 100 sec | 300 sec | 300 sec |
| Acetonitrile | NA | 6.67 mL | NA | NA | NA |

| B. 0.2 µmol Synthesis Cycle ABI 394 Instrument | | | | | |
|---|---|---|---|---|---|
| Reagent | Equivalents | Amount | Wait Time* DNA | Wait Time* 2'-O-methyl | Wait Time*RNA |
| Phosphoramidites | 15 | 31 µL | 45 sec | 233 sec | 465 sec |
| S-Ethyl Tetrazole | 38.7 | 31 µL | 45 sec | 233 min | 465 sec |
| Acetic Anhydride | 655 | 124 µL | 5 sec | 5 sec | 5 sec |
| N-Methyl Imidazole | 1245 | 124 µL | 5 sec | 5 sec | 5 sec |
| TCA | 700 | 732 µL | 10 sec | 10 sec | 10 sec |
| Iodine | 20.6 | 244 µL | 15 sec | 15 sec | 15 sec |
| Beaucage | 7.7 | 232 µL | 100 sec | 300 sec | 300 sec |
| Acetonitrile | NA | 2.64 mL | NA | NA | NA |

TABLE II-continued

C. 0.2 μmol Synthesis Cycle 96 well Instrument

| Reagent | Equivalents:DNA/ 2'-O-methyl/Ribo | Amount: DNA/2'-O-methyl/Ribo | Wait Time* DNA | Wait Time* 2'-O-methyl | Wait Time* Ribo |
|---|---|---|---|---|---|
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 min | 360 sec |
| Acetic Anhydride | 265/265/265 | 50/50/50 μL | 10 sec | 10 sec | 10 sec |
| N-Methyl Imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 | 100 sec | 200 sec | 200 sec |
| Acetonitrile | NA | 1150/1150/1150 μL | NA | NA | NA |

*Wait time does not include contact time during delivery.

TABLE III

Human IKK-gamma Hammerhead and Substrate Sequence

| Pos | Substrate | Seq ID | Hammerhead | Seq ID |
|---|---|---|---|---|
| 18 | AUGGCCCU U GUGAUCCA | 4361 | UGGAUCAC CUGAUGAGGCCGUUAGGCCGAA AGGGCCAU | 4555 |
| 24 | CUUGUGAU C CAGGUGGG | 4362 | CCCACCUG CUGAUGAGGCCGUUAGGCCGAA AUCACAAG | 4556 |
| 39 | GGGAAACU A AGGCCCAG | 4363 | CUGGGCCU CUGAUGAGGCCGUUAGGCCGAA AGUUUCCC | 4557 |
| 70 | CGCAGACU A UCAAUCCC | 4364 | GGGAUUGA CUGAUGAGGCCGUUAGGCCGAA AGUCUGCG | 4558 |
| 72 | CAGACUAU C AAUCCCAG | 4365 | CUGGGAUU CUGAUGAGGCCGUUAGGCCGAA AUAGUCUG | 4559 |
| 76 | CUAUCAAU C CCAGUCUC | 4366 | GAGACUGG CUGAUGAGGCCGUUAGGCCGAA AUUGAUAG | 4560 |
| 82 | AUCCCAGU C UCUUCCCC | 4367 | GGGGAAGA CUGAUGAGGCCGUUAGGCCGAA ACUGGGAU | 4561 |
| 84 | CCCAGUCU C UUCCCCUC | 4368 | GAGGGGAA CUGAUGAGGCCGUUAGGCCGAA AGACUGGG | 4562 |
| 86 | CAGUCUCU U CCCCUCAC | 4369 | GUGAGGGG CUGAUGAGGCCGUUAGGCCGAA AGAGACUG | 4563 |
| 87 | AGUCUCUU C CCCUCACU | 4370 | AGUGAGGG CUGAUGAGGCCGUUAGGCCGAA AAGAGACU | 4564 |
| 92 | CUUCCCCU C ACUCCCUG | 4371 | CAGGGAGU CUGAUGAGGCCGUUAGGCCGAA AGGGGAAG | 4565 |
| 96 | CCCUCACU C CCUGUGAA | 4372 | UUCACAGG CUGAUGAGGCCGUUAGGCCGAA AGUGAGGG | 4566 |
| 108 | GUGAAGCU C UCCAGCAU | 4373 | AUGCUGGA CUGAUGAGGCCGUUAGGCCGAA AGCUUCAC | 4567 |
| 110 | GAAGCUCU C CAGCAUCA | 4374 | UGAUGCUG CUGAUGAGGCCGUUAGGCCGAA AGAGCUUC | 4568 |
| 117 | UCCAGCAU C AUCGAGGU | 4375 | ACCUCGAU CUGAUGAGGCCGUUAGGCCGAA AUGCUGGA | 4569 |
| 120 | AGCAUCAU C GAGGUCCC | 4376 | GGGACCUC CUGAUGAGGCCGUUAGGCCGAA AUGAUGCU | 4570 |
| 126 | AUCGAGGU C CAUCAGC | 4377 | GCUGAUGG CUGAUGAGGCCGUUAGGCCGAA ACCUCGAU | 4571 |
| 131 | GGUCCCAU C AGCCCUUG | 4378 | CAAGGGCU CUGAUGAGGCCGUUAGGCCGAA AUGGGACC | 4572 |
| 138 | UCAGCCCU U GCCCUGUU | 4379 | AACAGGGC CUGAUGAGGCCGUUAGGCCGAA AGGGCUGA | 4573 |
| 146 | UGCCCUGU U GGAUGAAU | 4380 | AUUCAUCC CUGAUGAGGCCGUUAGGCCGAA ACAGGGCA | 4574 |
| 155 | GGAUGAAU A GCACCUC | 4381 | GAGGUGCC CUGAUGAGGCCGUUAGGCCGAA AUUCAUCC | 4575 |
| 163 | AGGCACCU C UGGAAGAG | 4382 | CUCUUCCA CUGAUGAGGCCGUUAGGCCGAA AGGUGCCU | 4576 |
| 218 | CAGCAGAU C AGGACGUA | 4383 | UACGUCCU CUGAUGAGGCCGUUAGGCCGAA AUCUGCUG | 4577 |
| 226 | CAGGACGU A CUGGGCGA | 4384 | UCGCCCAG CUGAUGAGGCCGUUAGGCCGAA ACGUCCUG | 4578 |
| 240 | CGAAGAGU C UCCUCUGG | 4385 | CCAGAGGA CUGAUGAGGCCGUUAGGCCGAA ACUCUUCG | 4579 |
| 242 | AAGAGUCU C CUCUGGGG | 4386 | CCCCAGAG CUGAUGAGGCCGUUAGGCCGAA AGACUCUU | 4580 |
| 245 | AGUCUCCU C UGGGGAAG | 4387 | CUUCCCCA CUGAUGAGGCCGUUAGGCCGAA AGGAGACU | 4581 |
| 275 | ACCUGCCU U CAGAACAG | 4388 | CUGUUCUG CUGAUGAGGCCGUUAGGCCGAA AGGCAGGU | 4582 |
| 276 | CCUGCCUU C AGAACAGG | 4389 | CCUGUUCU CUGAUGAGGCCGUUAGGCCGAA AAGGCAGG | 4583 |
| 290 | AGGGCGCU C CUGAGACC | 4390 | GGUCUCAG CUGAUGAGGCCGUUAGGCCGAA AGCGCCCU | 4584 |
| 301 | GAGACCCU C CAGCGCUG | 4391 | CAGCGCUG CUGAUGAGGCCGUUAGGCCGAA AGGGUCUC | 4585 |
| 323 | AGGAGAAU A AGAGCUC | 4392 | GAGCUCUU CUGAUGAGGCCGUUAGGCCGAA AUUCUCCU | 4586 |
| 331 | CAAGAGCU C CGAGAUGC | 4393 | GCAUCUCG CUGAUGAGGCCGUUAGGCCGAA AGCUCUUG | 4587 |
| 343 | GAUGCCAU C CGGCAGAG | 4394 | CUCUGCCG CUGAUGAGGCCGUUAGGCCGAA AUGGCAUC | 4588 |
| 361 | AACCAGAU U CUGCGGGA | 4395 | UCCCGCAG CUGAUGAGGCCGUUAGGCCGAA AUCUGGUU | 4589 |
| 362 | ACCAGAUU C UGCGGGAG | 4396 | CUCCCGCA CUGAUGAGGCCGUUAGGCCGAA AAUCUGGU | 4590 |
| 385 | GAGGAGCU U CUGCAUUU | 4397 | AAAUGCAG CUGAUGAGGCCGUUAGGCCGAA AGCUCCUC | 4591 |
| 386 | AGGAGCUU C UGCAUUUC | 4398 | GAAAUGCA CUGAUGAGGCCGUUAGGCCGAA AAGCUCCU | 4592 |
| 392 | UUCUGCAU U UCCAAGCC | 4399 | GGCUUGGA CUGAUGAGGCCGUUAGGCCGAA AUGCAGAA | 4593 |
| 393 | UCUGCAUU U CCAAGCCA | 4400 | UGGCUUGG CUGAUGAGGCCGUUAGGCCGAA AAUGCAGA | 4594 |
| 394 | CUGCAUUU C CAAGCAG | 4401 | CUGGCUUG CUGAUGAGGCCGUUAGGCCGAA AAAUGCAG | 4595 |
| 423 | GAAGGAGU U CCUCAUGU | 4402 | ACAUGAGG CUGAUGAGGCCGUUAGGCCGAA ACUCCUUC | 4596 |
| 424 | AAGGAGUU C CUCAUGUG | 4403 | CACAUGAG CUGAUGAGGCCGUUAGGCCGAA AACUCCUU | 4597 |
| 427 | GAGUUCCU C AUGUGCAA | 4404 | UUGCACAU CUGAUGAGGCCGUUAGGCCGAA AGGAACUC | 4598 |
| 438 | GUGCAAGU U CCAGGAGG | 4405 | CCUCCUGG CUGAUGAGGCCGUUAGGCCGAA ACUUGCAC | 4599 |
| 439 | UGCAAGUU C CAGGAGGC | 4406 | GCCUCCUG CUGAUGAGGCCGUUAGGCCGAA AACUUGCA | 4600 |
| 469 | GAGAGACU C GGCUGGA | 4407 | UCCAGGCC CUGAUGAGGCCGUUAGGCCGAA AGUCUCUC | 4601 |
| 484 | GAGAACGU C GAUCUGAA | 4408 | UUCAGAUC CUGAUGAGGCCGUUAGGCCGAA AGUCUUCU | 4602 |
| 488 | AGCUCGAU C UGAAGAGG | 4409 | CCUCUUCA CUGAUGAGGCCGUUAGGCCGAA AUCGAGCU | 4603 |
| 512 | AGCAGGCU C UGCGGGAG | 4410 | CUCCCGCA CUGAUGAGGCCGUUAGGCCGAA AGCCUGCU | 4604 |
| 570 | CAAGGCCU C UGUGAAAG | 4411 | CUUUCACA CUGAUGAGGCCGUUAGGCCGAA AGGCCUUG | 4605 |
| 591 | GGUGACGU C CUUGCUCG | 4412 | CGAGCAAG CUGAUGAGGCCGUUAGGCCGAA ACGUCACC | 4606 |
| 594 | GACGUCCU U GCUCGGGG | 4413 | CCCCGAGC CUGAUGAGGCCGUUAGGCCGAA AGGACGUC | 4607 |

TABLE III-continued

Human IKK-gamma Hammerhead and Substrate Sequence

| Pos | Substrate | Seq ID | Hammerhead | Seq ID |
|---|---|---|---|---|
| 598 | UCCUUGCU C GGGGAGCU | 4414 | AGCUCCCC CUGAUGAGGCCGUUAGGCCGAA AGCAAGGA | 4608 |
| 623 | GCCAGAGU C GCUUGGAG | 4415 | CUCCAAGC CUGAUGAGGCCGUUAGGCCGAA ACUCUGGC | 4609 |
| 627 | GAGUCGCU U GGAGGCUG | 4416 | CAGCCUCC CUGAUGAGGCCGUUAGGCCGAA AGCGACUC | 4610 |
| 641 | CUGCCACU A AGGAAUGC | 4417 | GCAUUCCU CUGAUGAGGCCGUUAGGCCGAA AGUGGCAG | 4611 |
| 656 | GCCAGGCU C UGGAGGGU | 4418 | ACCCUCCA CUGAUGAGGCCGUUAGGCCGAA AGCCUGGC | 4612 |
| 665 | UGGAGGGU C GGGCCCGG | 4419 | CCGGGCCC CUGAUGAGGCCGUUAGGCCGAA ACCCUCCA | 4613 |
| 787 | GCCGCGCU C CGCAUGGA | 4420 | UCCAUGCG CUGAUGAGGCCGUUAGGCCGAA AGCGCGGC | 4614 |
| 810 | GGCCGCCU C GGAGGAGA | 4421 | UCUCCUCC CUGAUGAGGCCGUUAGGCCGAA AGGCGGCC | 4615 |
| 837 | GGCCCAGU U GCAGGUGG | 4422 | CCACCUGC CUGAUGAGGCCGUUAGGCCGAA ACUGGGCC | 4616 |
| 849 | GGUGGCCU A UCACCAGC | 4423 | GCUGGUGA CUGAUGAGGCCGUUAGGCCGAA AGGCCACC | 4617 |
| 851 | UGGCCUAU C ACCAGCUC | 4424 | GAGCUGGU CUGAUGAGGCCGUUAGGCCGAA AUAGGCCA | 4618 |
| 859 | CACCAGCU C UUCCAAGA | 4425 | UCUUGGAA CUGAUGAGGCCGUUAGGCCGAA AGCUGGUG | 4619 |
| 861 | CCAGCUCU U CCAAGAAU | 4426 | AUUCUUGG CUGAUGAGGCCGUUAGGCCGAA AGAGCUGG | 4620 |
| 862 | CAGCUCUU C CAAGAAUA | 4427 | UAUUCUUG CUGAUGAGGCCGUUAGGCCGAA AAGAGCUG | 4621 |
| 870 | CCAAGAAU A CGACAACC | 4428 | GGUUGUCG CUGAUGAGGCCGUUAGGCCGAA AUUCUUGG | 4622 |
| 883 | AACCACAU C AAGAGCAG | 4429 | CUGCUCUU CUGAUGAGGCCGUUAGGCCGAA AUGUGGUU | 4623 |
| 935 | UGGAAGAU C UCAAACAG | 4430 | CUGUUUGA CUGAUGAGGCCGUUAGGCCGAA AUCUUCCA | 4624 |
| 937 | GAAGAUCU C AAACAGCA | 4431 | UGCUGUUU CUGAUGAGGCCGUUAGGCCGAA AGAUCUUC | 4625 |
| 949 | CAGCAGCU C CAGCAGGC | 4432 | GCCUGCUG CUGAUGAGGCCGUUAGGCCGAA AGCUGCUG | 4626 |
| 991 | GAGGUGAU C GAUAAGCU | 4433 | AGCUUAUC CUGAUGAGGCCGUUAGGCCGAA AUCACCUC | 4627 |
| 995 | UGAUCGAU A AGCUGAAG | 4434 | CUUCAGCU CUGAUGAGGCCGUUAGGCCGAA AUCGAUCA | 4628 |
| 1027 | CACAAGAU U GUGAUGGA | 4435 | UCCAUCAC CUGAUGAGGCCGUUAGGCCGAA AUCUUGUG | 4629 |
| 1042 | GAGACCGU U CCGGUGCU | 4436 | AGCACCGG CUGAUGAGGCCGUUAGGCCGAA ACGGUCUC | 4630 |
| 1043 | AGACCGUU C CGGUGCUG | 4437 | CAGCACCG CUGAUGAGGCCGUUAGGCCGAA AACGGUCU | 4631 |
| 1067 | AGGCGGAU A UCUACAAG | 4438 | CUUGUAGA CUGAUGAGGCCGUUAGGCCGAA AUCCGCCU | 4632 |
| 1069 | GCGGAUAU C UACAAGGC | 4439 | GCCUUGUA CUGAUGAGGCCGUUAGGCCGAA AUAUCCGC | 4633 |
| 1071 | GGAUAUCU A CAAGGCGG | 4440 | CCGCCUUG CUGAUGAGGCCGUUAGGCCGAA AGAUAUCC | 4634 |
| 1083 | GGCGGACU U CCAGGCUG | 4441 | CAGCCUGG CUGAUGAGGCCGUUAGGCCGAA AGUCCGCC | 4635 |
| 1084 | GCGGACUU C CAGGCUGA | 4442 | UCAGCCUG CUGAUGAGGCCGUUAGGCCGAA AAGUCCGC | 4636 |
| 1132 | AAGGAGCU C CUGCAGGA | 4443 | UCCUGCAG CUGAUGAGGCCGUUAGGCCGAA AGCUCCUU | 4637 |
| 1167 | GAGGGAGU A CAGCAAAC | 4444 | GUUUGCUG CUGAUGAGGCCGUUAGGCCGAA ACUCCCUC | 4638 |
| 1190 | CCAGCUGU C AGGAGUCG | 4445 | CGACUCCU CUGAUGAGGCCGUUAGGCCGAA ACAGCUGG | 4639 |
| 1197 | UCAGGAGU C GGCCAGGA | 4446 | UCCUGGCC CUGAUGAGGCCGUUAGGCCGAA ACUCCUGA | 4640 |
| 1207 | GCCAGGAU C GAGGACAU | 4447 | AUGUCCUC CUGAUGAGGCCGUUAGGCCGAA AUCCUGGC | 4641 |
| 1231 | CGGCAUGU C GAGGUCUC | 4448 | GAGACCUC CUGAUGAGGCCGUUAGGCCGAA ACAUGCCG | 4642 |
| 1237 | GUCGAGGU C UCCCAGGC | 4449 | GCCUGGGA CUGAUGAGGCCGUUAGGCCGAA ACCUCGAC | 4643 |
| 1239 | CGAGGUCU C CCAGGCCC | 4450 | GGGCCUGG CUGAUGAGGCCGUUAGGCCGAA AGACCUCG | 4644 |
| 1251 | GGCCCCCU U GCCCCCCG | 4451 | CGGGGGGC CUGAUGAGGCCGUUAGGCCGAA AGGGGGCC | 4645 |
| 1269 | CCCUGCCU A CCUCUCCU | 4452 | AGGAGAGG CUGAUGAGGCCGUUAGGCCGAA AGGCAGGG | 4646 |
| 1273 | GCCUACCU C UCCUCUCC | 4453 | GGAGAGGA CUGAUGAGGCCGUUAGGCCGAA AGGUAGGC | 4647 |
| 1275 | CUACCUCU C CUCUCCCC | 4454 | GGGGAGAG CUGAUGAGGCCGUUAGGCCGAA AGAGGUAG | 4648 |
| 1278 | CCUCUCCU C UCCCCUGG | 4455 | CCAGGGGA CUGAUGAGGCCGUUAGGCCGAA AGGAGAGG | 4649 |
| 1280 | UCUCCUCU C CCCUGGCC | 4456 | GGCCAGGG CUGAUGAGGCCGUUAGGCCGAA AGAGGAGA | 4650 |
| 1332 | ACCUGACU C UGCUGUC | 4457 | GACAGCAG CUGAUGAGGCCGUUAGGCCGAA AGUCAGGU | 4651 |
| 1333 | CCUGACUU C UGCUGUCC | 4458 | GGACAGCA CUGAUGAGGCCGUUAGGCCGAA AAGUCAGG | 4652 |
| 1340 | UCUGCUGU C CAAGUGC | 4459 | GCACUUGG CUGAUGAGGCCGUUAGGCCGAA ACAGCAGA | 4653 |
| 1353 | GUGCCAGU A UCAGGCCC | 4460 | GGGCCUGA CUGAUGAGGCCGUUAGGCCGAA ACUGGCAC | 4654 |
| 1355 | GCCAGUAU C AGGCCCCU | 4461 | AGGGGCCU CUGAUGAGGCCGUUAGGCCGAA AUACUGGC | 4655 |
| 1367 | CCCCUGAU A UGGACACC | 4462 | GGUGUCCA CUGAUGAGGCCGUUAGGCCGAA AUCAGGGG | 4656 |
| 1384 | CUGCAGAU A CAUGUCAU | 4463 | AUGACAUG CUGAUGAGGCCGUUAGGCCGAA AUCUGCAG | 4657 |
| 1390 | AUACAUGU C AUGGAGUG | 4464 | CACUCCAU CUGAUGAGGCCGUUAGGCCGAA ACAUGUAU | 4658 |
| 1402 | GAGUGCAU U GAGUAGGG | 4465 | CCCUACUC CUGAUGAGGCCGUUAGGCCGAA AUGCACUC | 4659 |
| 1407 | CAUUGAGU A GGGCCGGC | 4466 | GCCGGCCC CUGAUGAGGCCGUUAGGCCGAA ACUCAAUG | 4660 |
| 1464 | CGUGCAGU C UGCGCUUU | 4467 | AAAGCGCA CUGAUGAGGCCGUUAGGCCGAA ACUGCACG | 4661 |
| 1471 | UCUGCGCU U UCCUCUCC | 4468 | GGAGAGGA CUGAUGAGGCCGUUAGGCCGAA AGCGCAGA | 4662 |
| 1472 | CUGCGCUU U CCUCUCCC | 4469 | GGGAGAGG CUGAUGAGGCCGUUAGGCCGAA AAGCGCAG | 4663 |
| 1473 | UGCGCUUU C CUCUCCCG | 4470 | CGGGAGAG CUGAUGAGGCCGUUAGGCCGAA AAAGCGCA | 4664 |
| 1476 | GCUUUCCU C UCCCGCCU | 4471 | AGGCGGGA CUGAUGAGGCCGUUAGGCCGAA AGGAAAGC | 4665 |
| 1478 | UUUCCUCU C CCGCCUGC | 4472 | GCAGGCGG CUGAUGAGGCCGUUAGGCCGAA AGAGGAAA | 4666 |
| 1489 | GCCUGCCU A GCCCAGGA | 4473 | UCCUGGGC CUGAUGAGGCCGUUAGGCCGAA AGGCAGGC | 4667 |
| 1565 | CGGCACCU U ACGCUUCA | 4474 | UGAAGCGU CUGAUGAGGCCGUUAGGCCGAA AGGUGCCG | 4668 |
| 1566 | GGCACCUU A CGCUUCAG | 4475 | CUGAAGCG CUGAUGAGGCCGUUAGGCCGAA AAGGUGCC | 4669 |
| 1571 | CUUACGCU U CAGCUGUU | 4476 | AACAGCUG CUGAUGAGGCCGUUAGGCCGAA AGCGUAAG | 4670 |
| 1572 | UUACGCUU C AGCUGUUG | 4477 | CAACAGCU CUGAUGAGGCCGUUAGGCCGAA AAGCGUAA | 4671 |
| 1579 | UCAGCUGU U GAUCCGCU | 4478 | AGCGGAUC CUGAUGAGGCCGUUAGGCCGAA ACAGCUGA | 4672 |
| 1583 | CUGUUGAU C CGCUGGUC | 4479 | GACCAGCG CUGAUGAGGCCGUUAGGCCGAA AUCAACAG | 4673 |
| 1591 | CCGCUGGU C CCCUCUUU | 4480 | AAAGAGGG CUGAUGAGGCCGUUAGGCCGAA ACCAGCGG | 4674 |
| 1596 | GGUCCCCU C UUUGGGG | 4481 | CCCCAAAA CUGAUGAGGCCGUUAGGCCGAA AGGGGACC | 4675 |
| 1598 | UCCCCUCU U UGGGGUA | 4482 | UACCCCAA CUGAUGAGGCCGUUAGGCCGAA AGAGGGGA | 4676 |
| 1599 | CCCCUCUU U UGGGGUAG | 4483 | CUACCCCA CUGAUGAGGCCGUUAGGCCGAA AAGAGGGG | 4677 |
| 1600 | CCCUCUUU U GGGGUAGA | 4484 | UCUACCCC CUGAUGAGGCCGUUAGGCCGAA AAAGAGGG | 4678 |
| 1606 | UUUGGGGU A GAUGCGGC | 4485 | GCCGCAUC CUGAUGAGGCCGUUAGGCCGAA ACCCCAAA | 4679 |
| 1621 | GCCCCGAU C AGGCCUGA | 4486 | UCAGGCCU CUGAUGAGGCCGUUAGGCCGAA AUCGGGGC | 4680 |
| 1632 | GCCUGACU C GCUGCUCU | 4487 | AGAGCAGC CUGAUGAGGCCGUUAGGCCGAA AGUCAGGC | 4681 |

TABLE III-continued

Human IKK-gamma Hammerhead and Substrate Sequence

| Pos | Substrate | Seq ID | Hammerhead | Seq ID |
|---|---|---|---|---|
| 1639 | UCGCUGCU C UUUUUGUU | 4488 | AACAAAAA CUGAUGAGGCCGUUAGGCCGAA AGCAGCGA | 4682 |
| 1641 | GCUGCUCU U UUUGUUCC | 4489 | GGAACAAA CUGAUGAGGCCGUUAGGCCGAA AGAGCAGC | 4683 |
| 1642 | CUGCUCUU U UUGUUCCC | 4490 | GGGAACAA CUGAUGAGGCCGUUAGGCCGAA AAGAGCAG | 4684 |
| 1643 | UGCUCUUU U UGUUCCCU | 4491 | AGGGAACA CUGAUGAGGCCGUUAGGCCGAA AAAAGCA | 4685 |
| 1644 | GCUCUUUU U GUUCCCUU | 4492 | AAGGGAAC CUGAUGAGGCCGUUAGGCCGAA AAAAGAGC | 4686 |
| 1647 | CUUUUUGU U CCCUUCUG | 4493 | CAGAAGGG CUGAUGAGGCCGUUAGGCCGAA ACAAAAAG | 4687 |
| 1648 | UUUUUGUU C CCUUCUGU | 4494 | ACAGAAGG CUGAUGAGGCCGUUAGGCCGAA AACAAAAA | 4688 |
| 1652 | UGUUCCCU U CUGUCUGC | 4495 | GCAGACAG CUGAUGAGGCCGUUAGGCCGAA AGGGAACA | 4689 |
| 1653 | GUUCCCUU C UGUCUGCU | 4496 | AGCAGACA CUGAUGAGGCCGUUAGGCCGAA AAGGGAAC | 4690 |
| 1657 | CCUUCUGU C UGCUCGAA | 4497 | UUCGAGCA CUGAUGAGGCCGUUAGGCCGAA ACAGAAGG | 4691 |
| 1662 | UGUCUGCU C GAACCACU | 4498 | AGUGGUUC CUGAUGAGGCCGUUAGGCCGAA AGCAGACA | 4692 |
| 1671 | GAACCACU U GCCUCGGG | 4499 | CCCGAGGC CUGAUGAGGCCGUUAGGCCGAA AGUGGUUC | 4693 |
| 1676 | ACUUGCCU C GGGCUAAU | 4500 | AUUAGCCC CUGAUGAGGCCGUUAGGCCGAA AGGCAAGU | 4694 |
| 1682 | CUCGGGCU A AUCCCUCC | 4501 | GGAGGGAU CUGAUGAGGCCGUUAGGCCGAA AGCCCGAG | 4695 |
| 1685 | GGGCUAAU C CCUCCCUC | 4502 | GAGGGAGG CUGAUGAGGCCGUUAGGCCGAA AUUAGCCC | 4696 |
| 1689 | UAAUCCCU C CCUCUUCC | 4503 | GGAAGAGG CUGAUGAGGCCGUUAGGCCGAA AGGGAUUA | 4697 |
| 1693 | CCCUCCCU C UUCCUCCA | 4504 | UGGAGGAA CUGAUGAGGCCGUUAGGCCGAA AGGGAGGG | 4698 |
| 1695 | CUCCCUCU U CCUCCACC | 4505 | GGUGGAGG CUGAUGAGGCCGUUAGGCCGAA AGAGGGAG | 4699 |
| 1696 | UCCCUCUU C CUCCACCC | 4506 | GGGUGGAG CUGAUGAGGCCGUUAGGCCGAA AAGAGGGA | 4700 |
| 1699 | CUCUUCCU C CACCCGGC | 4507 | GCCGGGUG CUGAUGAGGCCGUUAGGCCGAA AGGAAGAG | 4701 |
| 1719 | GGGGAAGU C AAGAAUGG | 4508 | CCAUUCUU CUGAUGAGGCCGUUAGGCCGAA ACUUCCCC | 4702 |
| 1739 | CUGGGCCU C UCAGGGAG | 4509 | CUCCCUGA CUGAUGAGGCCGUUAGGCCGAA AGCCCCAG | 4703 |
| 1741 | GGGCUCUC C AGGGAGAA | 4510 | UUCUCCCU CUGAUGAGGCCGUUAGGCCGAA AGAGCCCC | 4704 |
| 1755 | GAACUGCU U CCCCUGGC | 4511 | GCCAGGGG CUGAUGAGGCCGUUAGGCCGAA AGCAGUUC | 4705 |
| 1756 | AACUGCUU C CCCUGGCA | 4512 | UGCCAGGG CUGAUGAGGCCGUUAGGCCGAA AAGCAGUU | 4706 |
| 1781 | UGGCAGCU C UUCCUCCC | 4513 | GGGAGGAA CUGAUGAGGCCGUUAGGCCGAA AGCUGCCA | 4707 |
| 1783 | GCAGCUCU U CCUCCCAC | 4514 | GUGGGAGG CUGAUGAGGCCGUUAGGCCGAA AGAGCUGC | 4708 |
| 1784 | CAGCUCUU C CUCCCACC | 4515 | GGUGGGAG CUGAUGAGGCCGUUAGGCCGAA AAGAGCUG | 4709 |
| 1787 | CUCUUCCU C CACCGGA | 4516 | UCCGGUGG CUGAUGAGGCCGUUAGGCCGAA AGGAAGAG | 4710 |
| 1836 | GCUGCCCU C UUACCAUG | 4517 | CAUGGUAA CUGAUGAGGCCGUUAGGCCGAA AGGGCAGC | 4711 |
| 1838 | UGCCCUCU U ACCAUGCA | 4518 | UGCAUGGU CUGAUGAGGCCGUUAGGCCGAA AGAGGGCA | 4712 |
| 1839 | GCCCUCUU A CCAUGCAC | 4519 | GUGCAUGG CUGAUGAGGCCGUUAGGCCGAA AAGAGGGC | 4713 |
| 1857 | CGGGUGCU C UCCUUUUG | 4520 | CAAAAGGA CUGAUGAGGCCGUUAGGCCGAA AGCACCCG | 4714 |
| 1859 | GGUGCUCU C CUUUUGGG | 4521 | CCCAAAAG CUGAUGAGGCCGUUAGGCCGAA AGAGCACC | 4715 |
| 1862 | GCUCUCCU U UGGGCUG | 4522 | CAGCCCAA CUGAUGAGGCCGUUAGGCCGAA AGGAGAGC | 4716 |
| 1863 | CUCUCCUU U UGGGCUGC | 4523 | GCAGCCCA CUGAUGAGGCCGUUAGGCCGAA AAGGAGAG | 4717 |
| 1864 | UCUCCUUU U GGGCUGCA | 4524 | UGCAGCCC CUGAUGAGGCCGUUAGGCCGAA AAAGGAGA | 4718 |
| 1877 | UGCAUGCU A UUCCAUUU | 4525 | AAAUGGAA CUGAUGAGGCCGUUAGGCCGAA AGCAUGCA | 4719 |
| 1879 | CAUGCUAU U CCAUUUG | 4526 | CAAAAUGG CUGAUGAGGCCGUUAGGCCGAA AUAGCAUG | 4720 |
| 1880 | AUGCUAUU C CAUUUGC | 4527 | GCAAAAUG CUGAUGAGGCCGUUAGGCCGAA AAUAGCAU | 4721 |
| 1884 | UAUUCCAU U UUCCAGCC | 4528 | GGCUGCAA CUGAUGAGGCCGUUAGGCCGAA AUGGAAUA | 4722 |
| 1885 | AUUCCAUU U UGCAGCCA | 4529 | UGGCUGCA CUGAUGAGGCCGUUAGGCCGAA AAUGGAAU | 4723 |
| 1886 | UUCCAUUU U GCAGCCAG | 4530 | CUGGCUGC CUGAUGAGGCCGUUAGGCCGAA AAAUGGAA | 4724 |
| 1905 | CGAUGUGU A UUUAACCA | 4531 | UGGUUAAA CUGAUGAGGCCGUUAGGCCGAA ACACAUCG | 4725 |
| 1907 | AUGUGUAU U UAACCAGU | 4532 | ACUGGUUA CUGAUGAGGCCGUUAGGCCGAA AUACACAU | 4726 |
| 1908 | UGUGUAUU U AACCAGUC | 4533 | GACUGGUU CUGAUGAGGCCGUUAGGCCGAA AAUACACA | 4727 |
| 1909 | GUGUAUUU A ACCAGUCA | 4534 | UGACUGGU CUGAUGAGGCCGUUAGGCCGAA AAAUACAC | 4728 |
| 1916 | UAACCAGU C ACUAUUGA | 4535 | UCAAUAGU CUGAUGAGGCCGUUAGGCCGAA ACUGGUUA | 4729 |
| 1920 | CAGUCACU A UUGAUGGA | 4536 | UCCAUCAA CUGAUGAGGCCGUUAGGCCGAA AGUGACUG | 4730 |
| 1922 | GUCACUAU U GAUGGACA | 4537 | UGUCCAUC CUGAUGAGGCCGUUAGGCCGAA AUAGUGAC | 4731 |
| 1932 | AUGGACAU U UGGGUUGU | 4538 | ACAACCCA CUGAUGAGGCCGUUAGGCCGAA AUGUCCAU | 4732 |
| 1933 | UGGACAUU U GGGUUGUU | 4539 | AACAACCC CUGAUGAGGCCGUUAGGCCGAA AAUGUCCA | 4733 |
| 1938 | AUUUGGGU U GUUUCCCA | 4540 | UGGGAAAC CUGAUGAGGCCGUUAGGCCGAA ACCCAAAU | 4734 |
| 1941 | UGGGUUGU U UCCAUCU | 4541 | AGAUGGGA CUGAUGAGGCCGUUAGGCCGAA ACAACCCA | 4735 |
| 1942 | GGGUUGUU C CCAUCUU | 4542 | AAGAUGGG CUGAUGAGGCCGUUAGGCCGAA AACAACCC | 4736 |
| 1943 | GGUUGUUU C CAUCUUU | 4543 | AAAGAUGG CUGAUGAGGCCGUUAGGCCGAA AAACAACC | 4737 |
| 1948 | UUUCCCAU C UUUUGUU | 4544 | AACAAAAA CUGAUGAGGCCGUUAGGCCGAA AUGGGAAA | 4738 |
| 1950 | UCCCAUCU U UUUGUUAC | 4545 | GUAACAAA CUGAUGAGGCCGUUAGGCCGAA AGAUGGGA | 4739 |
| 1951 | CCCAUCUU U UUGUUACC | 4546 | GGUAACAA CUGAUGAGGCCGUUAGGCCGAA AAGAUGGG | 4740 |
| 1952 | CCAUCUUU U UGUUACCA | 4547 | UGGUAACA CUGAUGAGGCCGUUAGGCCGAA AAAGAUGG | 4741 |
| 1953 | CAUCUUUU U GUUACCAU | 4548 | AUGGUAAC CUGAUGAGGCCGUUAGGCCGAA AAAAGAUG | 4742 |
| 1956 | CUUUUUGU U ACCAUAAA | 4549 | UUUAUGGU CUGAUGAGGCCGUUAGGCCGAA ACAAAAAG | 4743 |
| 1957 | UUUUUGUU A CCAUAAAU | 4550 | AUUUAUGG CUGAUGAGGCCGUUAGGCCGAA AACAAAAA | 4744 |
| 1962 | GUUACCAU A AAUAAUGG | 4551 | CCAUUAUU CUGAUGAGGCCGUUAGGCCGAA AUGGUAAC | 4745 |
| 1966 | CCAUAAAU A AUGGCAUA | 4552 | UAUGCCAU CUGAUGAGGCCGUUAGGCCGAA AUUUAUGG | 4746 |
| 1974 | AAUGGCAU A GUAAAAAA | 4553 | UUUUUUAC CUGAUGAGGCCGUUAGGCCGAA AUGCCAUU | 4747 |
| 1977 | GGCAUAGU A AAAAAAAA | 4554 | UUUUUUUU CUGAUGAGGCCGUUAGGCCGAA ACUAUGCC | 4748 |

Input Sequence = NM_003639. Cut Site = UH/.
Arm Length = 8. Core Sequence = CUGAUGAG GCCGUUAGGC CGAA
NM_003639 (*Homo sapiens* inhibitor of kappa light polypeptide gene enhancer in B-cells, kinase gamma (IKBKG), mRNA.; 1994 bp)

Underlined region can be any X sequence or linker, as described herein.

TABLE IV

Human IKK-gamma Inozyme and Substrate Sequence

| Pos | Substrate | Seq ID | Inozyme | Seq ID |
|---|---|---|---|---|
| 10 | GCACGAGC A UGGCCCUU | 4749 | AAGGGCCA CUGAUGAGGCCGUUAGGCCGAA ICUCGUGC | 5253 |
| 15 | AGCAUGGC C CUUGUGAU | 4750 | AUCACAAG CUGAUGAGGCCGUUAGGCCGAA ICCAUGCU | 5254 |
| 16 | GCAUGGCC C UUGUGAUC | 4751 | GAUCACAA CUGAUGAGGCCGUUAGGCCGAA IGCCAUGC | 5255 |
| 17 | CAUGGCCC U UGUGAUCC | 4752 | GGAUCACA CUGAUGAGGCCGUUAGGCCGAA IGGCCAUG | 5256 |
| 25 | UUGUGAUC C AGGUGGGG | 4753 | CCCCACCU CUGAUGAGGCCGUUAGGCCGAA IAUCACAA | 5257 |
| 26 | UGUGAUCC A GGUGGGGA | 4754 | UCCCCACC CUGAUGAGGCCGUUAGGCCGAA IGAUCACA | 5258 |
| 38 | GGGGAAAC U AAGGCCCA | 4755 | UGGGCCUU CUGAUGAGGCCGUUAGGCCGAA IUUUCCCC | 5259 |
| 44 | ACUAAGGC C CAGAGAAG | 4756 | CUUCUCUG CUGAUGAGGCCGUUAGGCCGAA ICCUUAGU | 5260 |
| 45 | CUAAGGCC C AGAGAAGU | 4757 | ACUUCUCU CUGAUGAGGCCGUUAGGCCGAA IGCCUUAG | 5261 |
| 46 | UAAGGCCC A GAGAAGUG | 4758 | CACUUCUC CUGAUGAGGCCGUUAGGCCGAA IGGCCUUA | 5262 |
| 60 | GUGAGGAC C CCGCAGAC | 4759 | GUCUGCGG CUGAUGAGGCCGUUAGGCCGAA IUCCUCAC | 5263 |
| 61 | UGAGGACC C CGCAGACU | 4760 | AGUCUGCG CUGAUGAGGCCGUUAGGCCGAA IGUCCUCA | 5264 |
| 62 | GAGGACCC C GCAGACUA | 4761 | UAGUCUGC CUGAUGAGGCCGUUAGGCCGAA IGGUCCUC | 5265 |
| 65 | GACCCCGC A GACUAUCA | 4762 | UGAUAGUC CUGAUGAGGCCGUUAGGCCGAA ICGGGGUC | 5266 |
| 69 | CCGCAGAC U AUCAAUCC | 4763 | GGAUUGAU CUGAUGAGGCCGUUAGGCCGAA IUCUGCGG | 5267 |
| 73 | AGACUAUC A AUCCCAGU | 4764 | ACUGGGAU CUGAUGAGGCCGUUAGGCCGAA IAUAGUCU | 5268 |
| 77 | UAUCAAUC C CAGUCUCU | 4765 | AGAGACUG CUGAUGAGGCCGUUAGGCCGAA IAUUGAUA | 5269 |
| 78 | AUCAAUCC C AGUCUCUU | 4766 | AAGAGACU CUGAUGAGGCCGUUAGGCCGAA IGAUUGAU | 5270 |
| 79 | UCAAUCCC A GUCUCUUC | 4767 | GAAGAGAC CUGAUGAGGCCGUUAGGCCGAA IGGAUUGA | 5271 |
| 83 | UCCCAGUC U CUUCCCU | 4768 | AGGGGAAG CUGAUGAGGCCGUUAGGCCGAA IACUGGGA | 5272 |
| 85 | CCAGUCUC U UCCCCUCA | 4769 | UGAGGGGA CUGAUGAGGCCGUUAGGCCGAA IAGACUGG | 5273 |
| 88 | GUCUCUUC C CCUCACUC | 4770 | GAGUGAGG CUGAUGAGGCCGUUAGGCCGAA IAAGAGAC | 5274 |
| 89 | UCUCUUCC C CUCACUCC | 4771 | GGAGUGAG CUGAUGAGGCCGUUAGGCCGAA IGAAGAGA | 5275 |
| 90 | CUCUUCCC C UCACUCCC | 4772 | GGGAGUGA CUGAUGAGGCCGUUAGGCCGAA IGGAAGAG | 5276 |
| 91 | UCUUCCCC U CACUCCCU | 4773 | AGGGAGUG CUGAUGAGGCCGUUAGGCCGAA IGGGAAGA | 5277 |
| 93 | UUCCCCUC A CUCCCUGU | 4774 | ACAGGGAG CUGAUGAGGCCGUUAGGCCGAA IAGGGGAA | 5278 |
| 95 | CCCCUCAC U CCCUGUGA | 4775 | UCACAGGG CUGAUGAGGCCGUUAGGCCGAA IUGAGGGG | 5279 |
| 97 | CCUCACUC C CUGUGAAG | 4776 | CUUCACAG CUGAUGAGGCCGUUAGGCCGAA IAGUGAGG | 5280 |
| 98 | CUCACUCC C UGUGAAGC | 4777 | GCUUCACA CUGAUGAGGCCGUUAGGCCGAA IGAGUGAG | 5281 |
| 99 | UCACUCCC U GUGAAGCU | 4778 | AGCUUCAC CUGAUGAGGCCGUUAGGCCGAA IGGAGUGA | 5282 |
| 107 | UGUGAAGC U CUCCAGCA | 4779 | UGCUGGAG CUGAUGAGGCCGUUAGGCCGAA ICUUCACA | 5283 |
| 109 | UGAAGCUC U CCAGCAUC | 4780 | GAUGCUGG CUGAUGAGGCCGUUAGGCCGAA IAGCUUCA | 5284 |
| 111 | AAGCUCUC C AGCAUCAU | 4781 | AUGAUGCU CUGAUGAGGCCGUUAGGCCGAA IAGAGCUU | 5285 |
| 112 | AGCUCUCC A GCAUCAUC | 4782 | GAUGAUGC CUGAUGAGGCCGUUAGGCCGAA IGAGAGCU | 5286 |
| 115 | UCUCCAGC A UCAUCGAG | 4783 | CUCGAUGA CUGAUGAGGCCGUUAGGCCGAA ICUGGAGA | 5287 |
| 118 | CCAGCAUC A UCGAGGUC | 4784 | GACCUCGA CUGAUGAGGCCGUUAGGCCGAA IAUGCUGG | 5288 |
| 127 | UCGAGGUC C CAUCAGCC | 4785 | GGCUGAUG CUGAUGAGGCCGUUAGGCCGAA IACCUCGA | 5289 |
| 128 | CGAGGUCC C AUCAGCCC | 4786 | GGGCUGAU CUGAUGAGGCCGUUAGGCCGAA IGACCUCG | 5290 |
| 129 | GAGGUCCC A UCAGCCCU | 4787 | AGGGCUGA CUGAUGAGGCCGUUAGGCCGAA IGGACCUC | 5291 |
| 132 | GUCCCAUC A GCCCUUGC | 4788 | GCAAGGGC CUGAUGAGGCCGUUAGGCCGAA IAUGGGAC | 5292 |
| 135 | CCAUCAGC C CUUGCCCU | 4789 | AGGGCAAG CUGAUGAGGCCGUUAGGCCGAA ICUGAUGG | 5293 |
| 136 | CAUCAGCC C UUGCCCUG | 4790 | CAGGGCAA CUGAUGAGGCCGUUAGGCCGAA IGCUGAUG | 5294 |
| 137 | AUCAGCCC U UGCCCUGU | 4791 | ACAGGGCA CUGAUGAGGCCGUUAGGCCGAA IGGCUGAU | 5295 |
| 141 | GCCCUUGC C CUGUUGGA | 4792 | UCCAACAG CUGAUGAGGCCGUUAGGCCGAA ICAAGGGC | 5296 |
| 142 | CCCUUGCC C UGUUGGAU | 4793 | AUCCAACA CUGAUGAGGCCGUUAGGCCGAA IGCAAGGG | 5297 |
| 143 | CCUUGCCC U GUUGGAUG | 4794 | CAUCCAAC CUGAUGAGGCCGUUAGGCCGAA IGGCAAGG | 5298 |
| 159 | GAAUAGGC A CCUCUGGA | 4795 | UCCAGAGG CUGAUGAGGCCGUUAGGCCGAA ICCUAUUC | 5299 |
| 161 | AUAGGCAC C UCUGGAAG | 4796 | CUUCCAGA CUGAUGAGGCCGUUAGGCCGAA IUGCCUAU | 5300 |
| 162 | UAGGCACC U CUGGAAGA | 4797 | UCUUCCAG CUGAUGAGGCCGUUAGGCCGAA IGUGCCUA | 5301 |
| 164 | GGCACCUC U GGAAGAGC | 4798 | GCUCUUCC CUGAUGAGGCCGUUAGGCCGAA IAGGUGCC | 5302 |
| 173 | GGAAGAGC C AACUGUGU | 4799 | ACACAGUU CUGAUGAGGCCGUUAGGCCGAA ICUCUUCC | 5303 |
| 174 | GAAGAGCC A ACUGUGUG | 4800 | CACACAGU CUGAUGAGGCCGUUAGGCCGAA IGCUCUUC | 5304 |
| 177 | GAGCCAAC U GUGUGAGA | 4801 | UCUCACAC CUGAUGAGGCCGUUAGGCCGAA IUUGGCUC | 5305 |
| 192 | GAUGGUGC A GCCCAGUG | 4802 | CACUGGGC CUGAUGAGGCCGUUAGGCCGAA ICACCAUC | 5306 |
| 195 | GGUGCAGC C CAGUGGUG | 4803 | CACCACUG CUGAUGAGGCCGUUAGGCCGAA ICUGCACC | 5307 |
| 196 | GUGCAGCC C AGUGGUGG | 4804 | CCACCACU CUGAUGAGGCCGUUAGGCCGAA IGCUGCAC | 5308 |
| 197 | UGCAGCCC A GUGGUGGC | 4805 | GCCACCAC CUGAUGAGGCCGUUAGGCCGAA IGGCUGCA | 5309 |
| 206 | GUGGUGGC C CGGCAGCA | 4806 | UGCUGCCG CUGAUGAGGCCGUUAGGCCGAA ICCACCAC | 5310 |
| 207 | UGGUGGCC C GGCAGCAG | 4807 | CUGCUGCC CUGAUGAGGCCGUUAGGCCGAA IGCCACCA | 5311 |
| 211 | GGCCCGGC A GCAGAUCA | 4808 | UGAUCUGC CUGAUGAGGCCGUUAGGCCGAA ICCGGGCC | 5312 |
| 214 | CCGGCAGC A GAUCAGGA | 4809 | UCCUGAUC CUGAUGAGGCCGUUAGGCCGAA ICUGCCGG | 5313 |
| 219 | AGCAGAUC A GGACGUAC | 4810 | GUACGUCC CUGAUGAGGCCGUUAGGCCGAA IAUCUGCU | 5314 |
| 228 | GGACGUAC U GGGCGAAG | 4811 | CUUCGCCC CUGAUGAGGCCGUUAGGCCGAA IUACGUCC | 5315 |
| 241 | GAAGAGUC U CCUCUGGG | 4812 | CCCAGAGG CUGAUGAGGCCGUUAGGCCGAA IACUCUUC | 5316 |
| 243 | AGAGUCUC C UCUGGGGA | 4813 | UCCCCAGA CUGAUGAGGCCGUUAGGCCGAA IAGACUCU | 5317 |
| 244 | GAGUCUCC U CUGGGGAA | 4814 | UUCCCCAG CUGAUGAGGCCGUUAGGCCGAA IGAGACUC | 5318 |
| 246 | GUCUCCUC U GGGGAAGC | 4815 | GCUUCCCC CUGAUGAGGCCGUUAGGCCGAA IAGGAGAC | 5319 |
| 255 | GGGGAAGC C AGCCAUGC | 4816 | GCAUGGCU CUGAUGAGGCCGUUAGGCCGAA ICUUCCCC | 5320 |
| 256 | GGGAAGCC A GCCAUGCU | 4817 | AGCAUGGC CUGAUGAGGCCGUUAGGCCGAA IGCUUCCC | 5321 |
| 259 | AAGCCAGC C AUGCUGCA | 4818 | UGCAGCAU CUGAUGAGGCCGUUAGGCCGAA ICUGGCUU | 5322 |

TABLE IV-continued

Human IKK-gamma Inozyme and Substrate Sequence

| Pos | Substrate | Seq ID | Inozyme | Seq ID |
|---|---|---|---|---|
| 260 | AGCCAGCC A UGCUGCAC | 4819 | GUGCAGCA CUGAUGAGGCCGUUAGGCCGAA IGCUGGCU | 5323 |
| 264 | AGCCAUGC U GCACCUGC | 4820 | GCAGGUGC CUGAUGAGGCCGUUAGGCCGAA ICAUGGCU | 5324 |
| 267 | CAUGCUGC A CCUGCCUU | 4821 | AAGGCAGG CUGAUGAGGCCGUUAGGCCGAA ICAGCAUG | 5325 |
| 269 | UGCUGCAC C UGCCUUCA | 4822 | UGAAGGCA CUGAUGAGGCCGUUAGGCCGAA IUGCAGCA | 5326 |
| 270 | GCUGCACC U GCCUUCAG | 4823 | CUGAAGGC CUGAUGAGGCCGUUAGGCCGAA IGUGCAGC | 5327 |
| 273 | GCACCUGC C UUCAGAAC | 4824 | GUUCUGAA CUGAUGAGGCCGUUAGGCCGAA ICAGGUGC | 5328 |
| 274 | CACCUGCC U UCAGAACA | 4825 | UGUUCUGA CUGAUGAGGCCGUUAGGCCGAA IGCAGGUG | 5329 |
| 277 | CUGCCUUC A GAACAGGG | 4826 | CCCUGUUC CUGAUGAGGCCGUUAGGCCGAA IAAGGCAG | 5330 |
| 282 | UUCAGAAC A GGGCGCUC | 4827 | GAGCGCCC CUGAUGAGGCCGUUAGGCCGAA IUUCUGAA | 5331 |
| 289 | CAGGGCGC U CCUGAGAC | 4828 | GUCUCAGG CUGAUGAGGCCGUUAGGCCGAA ICGCCCUG | 5332 |
| 291 | GGGCGCUC C UGAGACCC | 4829 | GGGUCUCA CUGAUGAGGCCGUUAGGCCGAA IAGCGCCC | 5333 |
| 292 | GGCGCUCC U GAGACCCU | 4830 | AGGGUCUC CUGAUGAGGCCGUUAGGCCGAA IGAGCGCC | 5334 |
| 298 | CCUGAGAC C UCCAGCG | 4831 | CGCUGGAG CUGAUGAGGCCGUUAGGCCGAA IUCUCAGG | 5335 |
| 299 | CUGAGACC C UCCAGCGC | 4832 | GCGCUGGA CUGAUGAGGCCGUUAGGCCGAA IGUCUCAG | 5336 |
| 300 | UGAGACCC U CCAGCGCU | 4833 | AGCGCUGG CUGAUGAGGCCGUUAGGCCGAA IGGUCUCA | 5337 |
| 302 | AGACCCUC C AGCGCUGC | 4834 | GCAGCGCU CUGAUGAGGCCGUUAGGCCGAA IAGGGUCU | 5338 |
| 303 | GACCCUCC A GCGCUGCC | 4835 | GGCAGCGC CUGAUGAGGCCGUUAGGCCGAA IGAGGGUC | 5339 |
| 308 | UCCAGCGC U GCCUGGAG | 4836 | CUCCAGGC CUGAUGAGGCCGUUAGGCCGAA ICGCUGGA | 5340 |
| 311 | AGCGCUGC C UGGAGGAG | 4837 | CUCCUCCA CUGAUGAGGCCGUUAGGCCGAA ICAGCGCU | 5341 |
| 312 | GCGCUGCC U GGAGGAGA | 4838 | UCUCCUCC CUGAUGAGGCCGUUAGGCCGAA IGCAGCGC | 5342 |
| 324 | GGAGAAUC A AGAGCUCC | 4839 | GGAGCUCU CUGAUGAGGCCGUUAGGCCGAA IAUUCUCC | 5343 |
| 330 | UCAAGAGC U CCGAGAUG | 4840 | CAUCUCGG CUGAUGAGGCCGUUAGGCCGAA ICUCUUGA | 5344 |
| 332 | AAGAGCUC C GAGAUGCC | 4841 | GGCAUCUC CUGAUGAGGCCGUUAGGCCGAA IAGCUCUU | 5345 |
| 340 | CGAGAUGC C AUCCGGCA | 4842 | UGCCGGAU CUGAUGAGGCCGUUAGGCCGAA ICAUCUCG | 5346 |
| 341 | GAGAUGCC A UCCGGCAG | 4843 | CUGCCGGA CUGAUGAGGCCGUUAGGCCGAA IGCAUCUC | 5347 |
| 344 | AUGCCAUC C GGCAGAGC | 4844 | GCUCUGCC CUGAUGAGGCCGUUAGGCCGAA IAUGGCAU | 5348 |
| 348 | CAUCCGGC A GAGCAACC | 4845 | GGUUGCUC CUGAUGAGGCCGUUAGGCCGAA ICCGGAUG | 5349 |
| 353 | GGCAGAGC A ACCAGAUU | 4846 | AAUCUGGU CUGAUGAGGCCGUUAGGCCGAA ICUCUGCC | 5350 |
| 356 | AGAGCAAC C AGAUUCUG | 4847 | CAGAAUCU CUGAUGAGGCCGUUAGGCCGAA IUUGCUCU | 5351 |
| 357 | GAGCAACC A GAUUCUGC | 4848 | GCAGAAUC CUGAUGAGGCCGUUAGGCCGAA IGUUGCUC | 5352 |
| 363 | CCAGAUUC U GCGGGAGC | 4849 | GCUCCCGC CUGAUGAGGCCGUUAGGCCGAA IAAUCUGG | 5353 |
| 374 | GGGAGCGC U GCGAGGAG | 4850 | CUCCUCGC CUGAUGAGGCCGUUAGGCCGAA ICGCUCCC | 5354 |
| 384 | CGAGGAGC U UCUGCAUU | 4851 | AAUGCAGA CUGAUGAGGCCGUUAGGCCGAA ICUCCUCG | 5355 |
| 387 | GGAGCUUC U GCAUUCC | 4852 | GGAAAUGC CUGAUGAGGCCGUUAGGCCGAA IAAGCUCC | 5356 |
| 390 | GCUUCUGC A UUUCCAAG | 4853 | CUUGGAAA CUGAUGAGGCCGUUAGGCCGAA ICAGAAGC | 5357 |
| 395 | UGCAUUUC C AAGCCAGC | 4854 | GCUGGCUU CUGAUGAGGCCGUUAGGCCGAA IAAAUGCA | 5358 |
| 396 | GCAUUUCC A AGCCAGCC | 4855 | GGCUGGCU CUGAUGAGGCCGUUAGGCCGAA IGAAAUGC | 5359 |
| 400 | UUCCAAGC C AGCCAGAG | 4856 | CUCUGGCU CUGAUGAGGCCGUUAGGCCGAA ICUUGGAA | 5360 |
| 401 | UCCAAGCC A GCCAGAGG | 4857 | CCUCUGGC CUGAUGAGGCCGUUAGGCCGAA IGCUUGGA | 5361 |
| 404 | AAGCCAGC C AGAGGGAG | 4858 | CUCCCUCU CUGAUGAGGCCGUUAGGCCGAA ICUGGCUU | 5362 |
| 405 | AGCCAGCC A GAGGGAGG | 4859 | CCUCCCUC CUGAUGAGGCCGUUAGGCCGAA IGCUGGCU | 5363 |
| 425 | AGGAGUUC C UCAUGUGC | 4860 | GCACAUGA CUGAUGAGGCCGUUAGGCCGAA IAACUCCU | 5364 |
| 426 | GGAGUUCC U CAUGUGCA | 4861 | UGCACAUG CUGAUGAGGCCGUUAGGCCGAA IGAACUCC | 5365 |
| 428 | AGUUCCUC A UGUGCAAG | 4862 | CUUGCACA CUGAUGAGGCCGUUAGGCCGAA IAGGAACU | 5366 |
| 434 | UCAUGUGC A AGUUCCAG | 4863 | CUGGAACU CUGAUGAGGCCGUUAGGCCGAA ICACAUGA | 5367 |
| 440 | GCAAGUUC C AGGAGGCC | 4864 | GGCCUCCU CUGAUGAGGCCGUUAGGCCGAA IAACUUGC | 5368 |
| 441 | CAAGUUCC A GGAGGCCA | 4865 | UGGCCUCC CUGAUGAGGCCGUUAGGCCGAA IGAACUUG | 5369 |
| 448 | CAGGAGGC C AGGAAACU | 4866 | AGUUUCCU CUGAUGAGGCCGUUAGGCCGAA ICCUCCUG | 5370 |
| 449 | AGGAGGCC A GGAAACUG | 4867 | CAGUUUCC CUGAUGAGGCCGUUAGGCCGAA IGCCUCCU | 5371 |
| 456 | CAGGAAAC U GGUGGAGA | 4868 | UCUCCACC CUGAUGAGGCCGUUAGGCCGAA IUUUCCUG | 5372 |
| 468 | GGAGAGAC U CGGCCUGG | 4869 | CCAGGCCG CUGAUGAGGCCGUUAGGCCGAA IUCUCUCC | 5373 |
| 473 | GACUCGGC C UGGAGAAG | 4870 | CUUCUCCA CUGAUGAGGCCGUUAGGCCGAA ICCGAGUC | 5374 |
| 474 | ACUCGGCC U GGAGAAGC | 4871 | GCUUCUCC CUGAUGAGGCCGUUAGGCCGAA IGCCGAGU | 5375 |
| 483 | GGAGAAGC U CGAUCUGA | 4872 | UCAGAUCG CUGAUGAGGCCGUUAGGCCGAA ICUUCUCC | 5376 |
| 489 | GCUCGAUC U GAAGAGGC | 4873 | GCCUCUUC CUGAUGAGGCCGUUAGGCCGAA IAUCGAGC | 5377 |
| 498 | GAAGAGGC A GAAGGAGC | 4874 | GCUCCUUC CUGAUGAGGCCGUUAGGCCGAA ICCUCUUC | 5378 |
| 507 | GAAGGAGC A GGCUCUGC | 4875 | GCAGAGCC CUGAUGAGGCCGUUAGGCCGAA ICUCCUUC | 5379 |
| 511 | GAGCAGGC U CUGCGGGA | 4876 | UCCCGCAG CUGAUGAGGCCGUUAGGCCGAA ICCUGCUC | 5380 |
| 513 | GCAGGCUC U GCGGGAGG | 4877 | CCUCCCGC CUGAUGAGGCCGUUAGGCCGAA IAGCCUGC | 5381 |
| 528 | GGUGGAGC A CCUGAAGA | 4878 | UCUUCAGG CUGAUGAGGCCGUUAGGCCGAA ICUCCACC | 5382 |
| 530 | UGGAGCAC C UGAAGAGA | 4879 | UCUCUUCA CUGAUGAGGCCGUUAGGCCGAA IUGCUCCA | 5383 |
| 531 | GGAGCACC U GAAGAGAU | 4880 | AUCUCUUC CUGAUGAGGCCGUUAGGCCGAA IGUGCUCC | 5384 |
| 542 | AGAGAUGC C AGCAGCAG | 4881 | CUGCUGCU CUGAUGAGGCCGUUAGGCCGAA ICAUCUCU | 5385 |
| 543 | GAGAUGCC A GCAGCAGA | 4882 | UCUGCUGC CUGAUGAGGCCGUUAGGCCGAA IGCAUCUC | 5386 |
| 546 | AUGCCAGC A GCAGAUGG | 4883 | CCAUCUGC CUGAUGAGGCCGUUAGGCCGAA ICUGGCAU | 5387 |
| 549 | CCAGCAGC A GAUGGCUG | 4884 | CAGCCAUC CUGAUGAGGCCGUUAGGCCGAA ICUGCUGG | 5388 |
| 556 | CAGAUGGC U GAGGACAA | 4885 | UUGUCCUC CUGAUGAGGCCGUUAGGCCGAA ICCAUCUG | 5389 |
| 563 | CUGAGGAC A AGGCCUCU | 4886 | AGAGGCCU CUGAUGAGGCCGUUAGGCCGAA IUCCUCAG | 5390 |
| 568 | GACAAGGC C UCUGUGAA | 4887 | UUCACAGA CUGAUGAGGCCGUUAGGCCGAA ICCUUGUC | 5391 |
| 569 | ACAAGGCC U CUGUGAAA | 4888 | UUUCACAG CUGAUGAGGCCGUUAGGCCGAA IGCCUUGU | 5392 |
| 571 | AAGGCCUC U GUGAAAGC | 4889 | GCUUUCAC CUGAUGAGGCCGUUAGGCCGAA IAGGCCUU | 5393 |
| 580 | GUGAAAGC C CAGGUGAC | 4890 | GUCACCUG CUGAUGAGGCCGUUAGGCCGAA ICUUUCAC | 5394 |
| 581 | UGAAAGCC C AGGUGACG | 4891 | CGUCACCU CUGAUGAGGCCGUUAGGCCGAA IGCUUUCA | 5395 |
| 582 | GAAAGCCC A GGUGACGU | 4892 | ACGUCACC CUGAUGAGGCCGUUAGGCCGAA IGGCUUUC | 5396 |

TABLE IV-continued

Human IKK-gamma Inozyme and Substrate Sequence

| Pos | Substrate | Seq ID | Inozyme | Seq ID |
|---|---|---|---|---|
| 592 | GUGACGUC C UUGCUCGG | 4893 | CCGAGCAA CUGAUGAGGCCGUUAGGCCGAA IACGUCAC | 5397 |
| 593 | UGACGUCC U UGCUCGGG | 4894 | CCCGAGCA CUGAUGAGGCCGUUAGGCCGAA IGACGUCA | 5398 |
| 597 | GUCCUUGC U CGGGGAGC | 4895 | GCUCCCCG CUGAUGAGGCCGUUAGGCCGAA ICAAGGAC | 5399 |
| 606 | CGGGGAGC U GCAGGAGA | 4896 | UCUCCUGC CUGAUGAGGCCGUUAGGCCGAA ICUCCCCG | 5400 |
| 609 | GGAGCUGC A GGAGAGCC | 4897 | GGCUCUCC CUGAUGAGGCCGUUAGGCCGAA ICAGCUCC | 5401 |
| 617 | AGGAGAGC C AGAGUCGC | 4898 | GCGACUCU CUGAUGAGGCCGUUAGGCCGAA ICUCUCCU | 5402 |
| 618 | GGAGAGCC A GAGUCGCU | 4899 | AGCGACUC CUGAUGAGGCCGUUAGGCCGAA IGCUCUCC | 5403 |
| 626 | AGAGUCGC U UGGAGGCU | 4900 | AGCCUCCA CUGAUGAGGCCGUUAGGCCGAA ICGACUCU | 5404 |
| 634 | UUGGAGGC U GCCACUAA | 4901 | UUAGUGGC CUGAUGAGGCCGUUAGGCCGAA ICCUCCAA | 5405 |
| 637 | GAGGCUGC C ACUAAGGA | 4902 | UCCUUAGU CUGAUGAGGCCGUUAGGCCGAA ICAGCCUC | 5406 |
| 638 | AGGCUGCC A CUAAGGAA | 4903 | UUCCUUAG CUGAUGAGGCCGUUAGGCCGAA IGCAGCCU | 5407 |
| 640 | GCUGCCAC U AAGGAAUG | 4904 | CAUUCCUU CUGAUGAGGCCGUUAGGCCGAA IUGGCAGC | 5408 |
| 650 | AGGAAUGC C AGGCUCUG | 4905 | CAGAGCCU CUGAUGAGGCCGUUAGGCCGAA ICAUUCCU | 5409 |
| 651 | GGAAUCCC A GGCUCUGG | 4906 | CCAGAGCC CUGAUGAGGCCGUUAGGCCGAA IGCAUUCC | 5410 |
| 655 | UGCCAGGC U CGGAGGGG | 4907 | CCCUCCAG CUGAUGAGGCCGUUAGGCCGAA ICCUGGCA | 5411 |
| 657 | CCAGGCUC U GGAGGGUC | 4908 | GACCCUCC CUGAUGAGGCCGUUAGGCCGAA IAGCCUGG | 5412 |
| 670 | GGUCGGGC C CGGGCGGC | 4909 | GCCGCCCG CUGAUGAGGCCGUUAGGCCGAA ICCCGACC | 5413 |
| 671 | GUCGGGCC C GGGCGGCC | 4910 | GGCCGCCC CUGAUGAGGCCGUUAGGCCGAA IGCCCGAC | 5414 |
| 679 | CGGGCGGC C AGCGAGCA | 4911 | UGCUCGCU CUGAUGAGGCCGUUAGGCCGAA ICCGCCCG | 5415 |
| 680 | GGGCGGCC A GCGAGCAG | 4912 | CUGCUCGC CUGAUGAGGCCGUUAGGCCGAA IGCCGCCC | 5416 |
| 687 | CAGCGAGC A GGCGCGGC | 4913 | GCCGCGCC CUGAUGAGGCCGUUAGGCCGAA ICUCGCUG | 5417 |
| 696 | GGCGCGGC A GCUGGAGA | 4914 | UCUCCAGC CUGAUGAGGCCGUUAGGCCGAA ICCGCGCC | 5418 |
| 699 | GCGGCAGC U GGAGAGUG | 4915 | CACUCUCC CUGAUGAGGCCGUUAGGCCGAA ICUGCCGC | 5419 |
| 720 | CGAGGCGC U GCAGCAGC | 4916 | GCUGCUGC CUGAUGAGGCCGUUAGGCCGAA ICGCCUCG | 5420 |
| 723 | GGCGCUGC A GCAGCAGC | 4917 | GCUGCUGC CUGAUGAGGCCGUUAGGCCGAA ICAGCGCC | 5421 |
| 726 | GCUGCAGC A GCAGCACA | 4918 | UGUGCUGC CUGAUGAGGCCGUUAGGCCGAA ICUGCAGC | 5422 |
| 729 | GCAGCAGC A GCACAGCG | 4919 | CGCUGUGC CUGAUGAGGCCGUUAGGCCGAA ICUGCUGC | 5423 |
| 732 | GCAGCAGC A CAGCGUGC | 4920 | GCACGCUG CUGAUGAGGCCGUUAGGCCGAA ICUGCUGC | 5424 |
| 734 | AGCAGCAC A GCGUGCAG | 4921 | CUGCACGC CUGAUGAGGCCGUUAGGCCGAA IUGCUGCU | 5425 |
| 741 | CAGCGUGC A GGUGGACC | 4922 | GGUCCACC CUGAUGAGGCCGUUAGGCCGAA ICACGCUG | 5426 |
| 749 | AGGUGGAC C AGCUGCGC | 4923 | GCGCAGCU CUGAUGAGGCCGUUAGGCCGAA ICCACCU | 5427 |
| 750 | GGUGGACC A GCUGCGCA | 4924 | UGCGCAGC CUGAUGAGGCCGUUAGGCCGAA IGUCCACC | 5428 |
| 753 | GGACCAGC U GCGCAUGC | 4925 | GCAUGCGC CUGAUGAGGCCGUUAGGCCGAA ICUGGUCC | 5429 |
| 758 | AGCUGCGC A UGCAGGGC | 4926 | GCCCUGCA CUGAUGAGGCCGUUAGGCCGAA ICGCAGCU | 5430 |
| 762 | GCGCAUGC A GGGCCAGA | 4927 | UCUGGCCC CUGAUGAGGCCGUUAGGCCGAA ICAUGCGC | 5431 |
| 767 | UGCAGGGC C AGAGCGUG | 4928 | CACGCUCU CUGAUGAGGCCGUUAGGCCGAA ICCCUGCA | 5432 |
| 768 | GCAGGGCC A GAGCGUGG | 4929 | CCACGCUC CUGAUGAGGCCGUUAGGCCGAA IGCCCUGC | 5433 |
| 781 | GUGGAGGC C GCGCUCCG | 4930 | CGGAGCGC CUGAUGAGGCCGUUAGGCCGAA ICCUCCAC | 5434 |
| 786 | GGCCGCGC U CCGCAUGG | 4931 | CCAUGCGG CUGAUGAGGCCGUUAGGCCGAA ICGCGGCC | 5435 |
| 788 | CCGCGCUC C GCAUGGAG | 4932 | CUCCAUGC CUGAUGAGGCCGUUAGGCCGAA IAGCGCGG | 5436 |
| 791 | CGCUCCGC A UGGAGCGC | 4933 | GCGCUCCA CUGAUGAGGCCGUUAGGCCGAA ICGGAGCG | 5437 |
| 800 | UGGAGCGC C AGGCCGCC | 4934 | GGCGGCCU CUGAUGAGGCCGUUAGGCCGAA ICGCUCCA | 5438 |
| 801 | GGAGCGCC A GGCCGCCU | 4935 | AGGCGGCC CUGAUGAGGCCGUUAGGCCGAA IGCGCUCC | 5439 |
| 805 | CGCCAGGC C GCCUCGGA | 4936 | UCCGAGGC CUGAUGAGGCCGUUAGGCCGAA ICCUGGCG | 5440 |
| 808 | CAGGCCGC C UCGGAGGA | 4937 | UCCUCCGA CUGAUGAGGCCGUUAGGCCGAA ICGGCCUG | 5441 |
| 809 | AGGCCGCC U CGGAGGAG | 4938 | CUCCUCCG CUGAUGAGGCCGUUAGGCCGAA IGCGGCCU | 5442 |
| 828 | GAGGAAGC U GGCCCAGU | 4939 | ACUGGGCC CUGAUGAGGCCGUUAGGCCGAA ICUUCCUC | 5443 |
| 832 | AAGCUGGC C CAGUUGCA | 4940 | UGCAACUG CUGAUGAGGCCGUUAGGCCGAA ICCAGCUU | 5444 |
| 833 | AGCUGGCC C AGUUGCAG | 4941 | CUGCAACU CUGAUGAGGCCGUUAGGCCGAA IGCCAGCU | 5445 |
| 834 | GCUGGCCC A GUUGCAGG | 4942 | CCUGCAAC CUGAUGAGGCCGUUAGGCCGAA IGGCCAGC | 5446 |
| 840 | CCAGUUGC A GGUGGCCU | 4943 | AGGCCACC CUGAUGAGGCCGUUAGGCCGAA ICAACUGG | 5447 |
| 847 | CAGGUGGC C UAUCACCA | 4944 | UGGUGAUA CUGAUGAGGCCGUUAGGCCGAA ICCACCUG | 5448 |
| 848 | AGGUGGCC U AUCACCAG | 4945 | CUGGUGAU CUGAUGAGGCCGUUAGGCCGAA IGCCACCU | 5449 |
| 852 | GGCCUAUC A CCAGCUCU | 4946 | AGAGCUGG CUGAUGAGGCCGUUAGGCCGAA IAUAGGCC | 5450 |
| 854 | CCUAUCAC C AGCUCUUC | 4947 | GAAGAGCU CUGAUGAGGCCGUUAGGCCGAA IUGAUAGG | 5451 |
| 855 | CUAUCACC A GCUCUUCC | 4948 | GGAAGAGC CUGAUGAGGCCGUUAGGCCGAA IGUGAUAG | 5452 |
| 858 | UCACCAGC U CUUCCAAG | 4949 | CUUGGAAG CUGAUGAGGCCGUUAGGCCGAA ICUGGUGA | 5453 |
| 860 | ACCAGCUC U UCCAAGAA | 4950 | UUCUUGGA CUGAUGAGGCCGUUAGGCCGAA IAGCUGGU | 5454 |
| 863 | AGCUCUUC C AAGAAUAC | 4951 | GUAUUCUU CUGAUGAGGCCGUUAGGCCGAA IAAGAGCU | 5455 |
| 864 | GCUCUUCC A AGAAUACG | 4952 | CGUAUUCU CUGAUGAGGCCGUUAGGCCGAA IGAAGAGC | 5456 |
| 875 | AAUACGAC A ACCACAUC | 4953 | GAUGUGGU CUGAUGAGGCCGUUAGGCCGAA IUCGUAUU | 5457 |
| 878 | ACGACAAC C ACAUCAAG | 4954 | CUUGAUGU CUGAUGAGGCCGUUAGGCCGAA IUUGUCGU | 5458 |
| 879 | CGACAACC A CAUCAAGA | 4955 | UCUUGAUG CUGAUGAGGCCGUUAGGCCGAA IGUUGUCG | 5459 |
| 881 | ACAACCAC A UCAAGAGC | 4956 | GCUCUUGA CUGAUGAGGCCGUUAGGCCGAA IUGGUUGU | 5460 |
| 884 | ACCACAUC A AGAGCAGC | 4957 | GCUGCUCU CUGAUGAGGCCGUUAGGCCGAA IAUGUGGU | 5461 |
| 890 | UCAAGAGC A GCGUGGUG | 4958 | CACCACGC CUGAUGAGGCCGUUAGGCCGAA ICUCUUGA | 5462 |
| 902 | UGGUGGGC A GUGAGCGG | 4959 | CCGCUCAC CUGAUGAGGCCGUUAGGCCGAA ICCCACCA | 5463 |
| 924 | AGGAAUGC A GCUGGAAG | 4960 | CUUCCAGC CUGAUGAGGCCGUUAGGCCGAA ICAUUCCU | 5464 |
| 927 | AAUGCAGC U GGAAGAUC | 4961 | GAUCUUCC CUGAUGAGGCCGUUAGGCCGAA ICUGCAUU | 5465 |
| 936 | GGAAGAUC U CAAACAGC | 4962 | GCUGUUUG CUGAUGAGGCCGUUAGGCCGAA IAUCUUCC | 5466 |
| 938 | AAGAUCUC A AACAGCAG | 4963 | CUGCUGUU CUGAUGAGGCCGUUAGGCCGAA IAGAUCUU | 5467 |
| 942 | UCUCAAAC A GCAGCUCC | 4964 | GGAGCUGC CUGAUGAGGCCGUUAGGCCGAA IUUUGAGA | 5468 |
| 945 | CAAACAGC A GCUCCAGC | 4965 | GCUGGAGC CUGAUGAGGCCGUUAGGCCGAA ICUGUUUG | 5469 |
| 948 | ACAGCAGC U CCAGCAGG | 4966 | CCUGCUGG CUGAUGAGGCCGUUAGGCCGAA ICUGCUGU | 5470 |

TABLE IV-continued

Human IKK-gamma Inozyme and Substrate Sequence

| Pos | Substrate | Seq ID | Inozyme | Seq ID |
|---|---|---|---|---|
| 950 | AGCAGCUC C AGCAGGCC | 4967 | GGCCUGCU CUGAUGAGGCCGUUAGGCCGAA IAGCUGCU | 5471 |
| 951 | GCAGCUCC A GCAGGCCG | 4968 | CGGCCUGC CUGAUGAGGCCGUUAGGCCGAA IGAGCUGC | 5472 |
| 954 | GCUCCAGC A GGCCGAGG | 4969 | CCUCGGCC CUGAUGAGGCCGUUAGGCCGAA ICUGGAGC | 5473 |
| 958 | CAGCAGGC C GAGGAGGC | 4970 | GCCUCCUC CUGAUGAGGCCGUUAGGCCGAA ICCUGCUG | 5474 |
| 967 | GAGGAGGC C CUGGUGGC | 4971 | GCCACCAG CUGAUGAGGCCGUUAGGCCGAA ICCUCCUC | 5475 |
| 968 | AGGAGGCC C UGGUGGCC | 4972 | GGCCACCA CUGAUGAGGCCGUUAGGCCGAA IGCCUCCU | 5476 |
| 969 | GGAGGCCC U GGUGGCCA | 4973 | UGGCCACC CUGAUGAGGCCGUUAGGCCGAA IGGCCUCC | 5477 |
| 976 | CUGGUGGC C AAACAGGA | 4974 | UCCUGUUU CUGAUGAGGCCGUUAGGCCGAA ICCACCAG | 5478 |
| 977 | UGGUGGCC A AACAGGAG | 4975 | CUCCUGUU CUGAUGAGGCCGUUAGGCCGAA IGCCACCA | 5479 |
| 981 | GGCCAAAC A GGAGGUGA | 4976 | UCACCUCC CUGAUGAGGCCGUUAGGCCGAA IUUUGGCC | 5480 |
| 999 | CGAUAAGC U GAAGGAGG | 4977 | CCUCCUUC CUGAUGAGGCCGUUAGGCCGAA ICUUAUCG | 5481 |
| 1012 | GAGGAGGC C GAGCAGCA | 4978 | UGCUGCUC CUGAUGAGGCCGUUAGGCCGAA ICCUCCUC | 5482 |
| 1017 | GGCCGAGC A GCACAAGA | 4979 | UCUUGUGC CUGAUGAGGCCGUUAGGCCGAA ICUCGGCC | 5483 |
| 1020 | CGAGCAGC A CAAGAUGG | 4980 | CAAUCUUG CUGAUGAGGCCGUUAGGCCGAA ICUGCUCG | 5484 |
| 1022 | AGCAGCAC A AGAUUGUG | 4981 | CACAAUCU CUGAUGAGGCCGUUAGGCCGAA IUGCUGCU | 5485 |
| 1039 | AUGGAGAC C GUUCCGGU | 4982 | ACCGGAAC CUGAUGAGGCCGUUAGGCCGAA IUCUCCAU | 5486 |
| 1044 | GACCGUUC C GGUGCUGA | 4983 | UCAGCACC CUGAUGAGGCCGUUAGGCCGAA IAACGGUC | 5487 |
| 1050 | UCCGGUGC U GAAGGCCC | 4984 | GGGCCUUC CUGAUGAGGCCGUUAGGCCGAA ICACCGGA | 5488 |
| 1057 | CUGAAGGC C CAGGCGGA | 4985 | UCCGCCUG CUGAUGAGGCCGUUAGGCCGAA ICCUUCAG | 5489 |
| 1058 | UGAAGGCC C AGGCGGAU | 4986 | AUCCGCCU CUGAUGAGGCCGUUAGGCCGAA IGCCUUCA | 5490 |
| 1059 | GAAGGCCC A GGCGGAUA | 4987 | UAUCCGCC CUGAUGAGGCCGUUAGGCCGAA IGGCCUUC | 5491 |
| 1070 | CGGAUAUC U ACAAGGCG | 4988 | CGCCUUGU CUGAUGAGGCCGUUAGGCCGAA IAUAUCCG | 5492 |
| 1073 | AUAUCUAC A AGGCGGAC | 4989 | GUCCGCCU CUGAUGAGGCCGUUAGGCCGAA IUAGAUAU | 5493 |
| 1082 | AGGCGGAC U UCCAGGCU | 4990 | AGCCUGGA CUGAUGAGGCCGUUAGGCCGAA IUCCGCCU | 5494 |
| 1085 | CGGACUUC C AGGCUGAG | 4991 | CUCAGCCU CUGAUGAGGCCGUUAGGCCGAA IAAGUCCG | 5495 |
| 1086 | GGACUUCC A GGCUGAGA | 4992 | UCUCAGCC CUGAUGAGGCCGUUAGGCCGAA IGAAGUCC | 5496 |
| 1090 | UUCCAGGC U GAGAGGCA | 4993 | UGCCUCUC CUGAUGAGGCCGUUAGGCCGAA ICCUGGAA | 5497 |
| 1098 | UGAGAGGC A GGCCCGGG | 4994 | CCCGGGCC CUGAUGAGGCCGUUAGGCCGAA ICCUCUCA | 5498 |
| 1102 | AGGCAGGC C CGGGAGAA | 4995 | UUCUCCCG CUGAUGAGGCCGUUAGGCCGAA ICCUGCCU | 5499 |
| 1103 | GGCAGGCC C GGGAGAAG | 4996 | CUUCUCCC CUGAUGAGGCCGUUAGGCCGAA IGCCUGCC | 5500 |
| 1113 | GGAGAAGC U GGCCGAGA | 4997 | UCUCGGCC CUGAUGAGGCCGUUAGGCCGAA ICUUCUCC | 5501 |
| 1117 | AAGCUGGC C GAGAAGAA | 4998 | UUCUUCUC CUGAUGAGGCCGUUAGGCCGAA ICCAGCUU | 5502 |
| 1131 | GAAGGAGC U CCUGCAGG | 4999 | CCUGCAGG CUGAUGAGGCCGUUAGGCCGAA ICUCCUUC | 5503 |
| 1133 | AGGAGCUC C UGCAGGAG | 5000 | CUCCUGCA CUGAUGAGGCCGUUAGGCCGAA IAGCUCCU | 5504 |
| 1134 | GGAGCUCC U GCAGGAGC | 5001 | GCUCCUGC CUGAUGAGGCCGUUAGGCCGAA IGAGCUCC | 5505 |
| 1137 | GCUCCUGC A GGAGCAGC | 5002 | GCUGCUCC CUGAUGAGGCCGUUAGGCCGAA ICAGGAGC | 5506 |
| 1143 | GCAGGAGC A GCUGGAGC | 5003 | GCUCCAGC CUGAUGAGGCCGUUAGGCCGAA ICUCCUGC | 5507 |
| 1146 | GGAGCAGC U GGAGCAGC | 5004 | GCUGCUCC CUGAUGAGGCCGUUAGGCCGAA ICUGCUCC | 5508 |
| 1152 | GCUGGAGC A GCUGCAGA | 5005 | UCUGCAGC CUGAUGAGGCCGUUAGGCCGAA ICUCCAGC | 5509 |
| 1155 | GGAGCAGC U GCAGAGGG | 5006 | CCCUCUGC CUGAUGAGGCCGUUAGGCCGAA ICUGCUCC | 5510 |
| 1158 | GCAGCUGC A GAGGGAGU | 5007 | ACUCCCUC CUGAUGAGGCCGUUAGGCCGAA ICAGCUGC | 5511 |
| 1169 | GGGAGUAC A GCAAACUG | 5008 | CAGUUUGC CUGAUGAGGCCGUUAGGCCGAA IUACUCCC | 5512 |
| 1172 | AGUACAGC A AACUGAAG | 5009 | CUUCAGUU CUGAUGAGGCCGUUAGGCCGAA ICUGUACU | 5513 |
| 1176 | CAGCAAAC U GAAGGCCA | 5010 | UGGCCUUC CUGAUGAGGCCGUUAGGCCGAA IUUUGCUG | 5514 |
| 1183 | CUGAAGGC C AGCUGUCA | 5011 | UGACAGCU CUGAUGAGGCCGUUAGGCCGAA ICCUUCAG | 5515 |
| 1184 | UGAAGGCC A GCUGUCAG | 5012 | CUGACAGC CUGAUGAGGCCGUUAGGCCGAA IGCCUUCA | 5516 |
| 1187 | AGGCCAGC U GUCAGGAG | 5013 | CUCCUGAC CUGAUGAGGCCGUUAGGCCGAA ICUGGCCU | 5517 |
| 1191 | CAGCUGUC A GGAGUCGG | 5014 | CCGACUCC CUGAUGAGGCCGUUAGGCCGAA IACAGCUG | 5518 |
| 1201 | GAGUCGGC C GGAUCGAG | 5015 | UCGAUCCU CUGAUGAGGCCGUUAGGCCGAA ICCGACUC | 5519 |
| 1202 | AGUCGGCC A GGAUCGAG | 5016 | CUCGAUCC CUGAUGAGGCCGUUAGGCCGAA IGCCGACU | 5520 |
| 1214 | UCGAGGAC A UGAGGAAG | 5017 | CUUCCUCA CUGAUGAGGCCGUUAGGCCGAA IUCCUCGA | 5521 |
| 1227 | GAAGCGGA A UGUCGAGG | 5018 | CCUCGACA CUGAUGAGGCCGUUAGGCCGAA ICCGCUUC | 5522 |
| 1238 | UCGAGGUC U CCCAGGCC | 5019 | GGCCUGGG CUGAUGAGGCCGUUAGGCCGAA IACCUCGA | 5523 |
| 1240 | GAGGUCUC C CAGGCCCC | 5020 | GGGGCCUG CUGAUGAGGCCGUUAGGCCGAA IAGACCUC | 5524 |
| 1241 | AGGUCUCC C AGGCCCCU | 5021 | GGGGGCCU CUGAUGAGGCCGUUAGGCCGAA IGAGACCU | 5525 |
| 1242 | GGUCUCCC A GGCCCCUU | 5022 | AGGGGGCC CUGAUGAGGCCGUUAGGCCGAA IGGAGACC | 5526 |
| 1246 | UCCCAGGC C CCUUGCCC | 5023 | GGCAAGGG CUGAUGAGGCCGUUAGGCCGAA ICCUGGGA | 5527 |
| 1247 | CCCAGGCC C CUUGCCCC | 5024 | GGGCAAGG CUGAUGAGGCCGUUAGGCCGAA IGCCUGGG | 5528 |
| 1248 | CCAGGCCC C UUGCCCCC | 5025 | GGGGCAAG CUGAUGAGGCCGUUAGGCCGAA IGGCCUGG | 5529 |
| 1249 | CAGGCCCC U UGCCCCCU | 5026 | GGGGGCAA CUGAUGAGGCCGUUAGGCCGAA IGGGCCUG | 5530 |
| 1250 | AGGCCCCU U GCCCCCGC | 5027 | GGGGGGCA CUGAUGAGGCCGUUAGGCCGAA IGGGGCCU | 5531 |
| 1254 | CCCCUUGC C CCCGCCCC | 5028 | GGGCGGGG CUGAUGAGGCCGUUAGGCCGAA ICAAGGGG | 5532 |
| 1255 | CCCUUGCC C CCGCCCCC | 5029 | GGGGCGGG CUGAUGAGGCCGUUAGGCCGAA IGCAAGGG | 5533 |
| 1256 | CCUUGCCC C CGCCCCCU | 5030 | AGGGGCGG CUGAUGAGGCCGUUAGGCCGAA IGGCAAGG | 5534 |
| 1257 | CUUGCCCC C CGCCCCUG | 5031 | CAGGGGCG CUGAUGAGGCCGUUAGGCCGAA IGGGCAAG | 5535 |
| 1258 | UUGCCCCC C GCCCCUGC | 5032 | GCAGGGGC CUGAUGAGGCCGUUAGGCCGAA IGGGGCAA | 5536 |
| 1261 | CCCCCCGC C CCUGCCUA | 5033 | UAGGCAGG CUGAUGAGGCCGUUAGGCCGAA ICGGGGGG | 5537 |
| 1262 | CCCCCGCC C CUGCCUAC | 5034 | GUAGGCAG CUGAUGAGGCCGUUAGGCCGAA IGCGGGGG | 5538 |
| 1263 | CCCCGCCC C UGCCUACC | 5035 | GGUAGGCA CUGAUGAGGCCGUUAGGCCGAA IGGCGGGG | 5539 |
| 1264 | CCCGCCCC U GCCUACCU | 5036 | AGGUAGGC CUGAUGAGGCCGUUAGGCCGAA IGGGCGGG | 5540 |
| 2267 | GCCCCUGC C UACUCUC | 5037 | GAGAGGUA CUGAUGAGGCCGUUAGGCCGAA ICAGGGGC | 5541 |
| 1268 | CCCCUGCC U ACCUCCC | 5038 | GGAGAGGU CUGAUGAGGCCGUUAGGCCGAA IGCAGGGG | 5542 |
| 1271 | CUGCCUAC C UCUCCUCU | 5039 | AGAGGAGA CUGAUGAGGCCGUUAGGCCGAA IUAGGCAG | 5543 |
| 1272 | UGCCUACC U CUCCUCUC | 5040 | GAGAGGAG CUGAUGAGGCCGUUAGGCCGAA IGUAGGCA | 5544 |

TABLE IV-continued

Human IKK-gamma Inozyme and Substrate Sequence

| Pos | Substrate | Seq ID | Inozyme | Seq ID |
|---|---|---|---|---|
| 1274 | CCUACCUC U CCUCUCCC | 5041 | GGGAGAGG CUGAUGAGgccGUUAGGCCGAA IAGGUAGG | 5545 |
| 1276 | UACCUCUC C UCUCCCCU | 5042 | AGGGGAGA CUGAUGAGgccGUUAGGCCGAA IAGAGGUA | 5546 |
| 1277 | ACCUCUCC U CUCCCCUG | 5043 | CAGGGGAG CUGAUGAGgccGUUAGGCCGAA IAGAGGGU | 5547 |
| 1279 | CUCUCCUC U CCCCUGGC | 5044 | GCCAGGGG CUGAUGAGgccGUUAGGCCGAA IAGGAGAG | 5548 |
| 1281 | CUCCCUCU C CCUGGCCC | 5045 | GGGCCAGG CUGAUGAGgccGUUAGGCCGAA IAGAGGAG | 5549 |
| 1282 | UCCUCUCC C CUGGCCCU | 5046 | AGGGCCAG CUGAUGAGgccGUUAGGCCGAA IAGAGGGA | 5550 |
| 1283 | CCUCUCCC C UGGCCCUG | 5047 | CAGGGCCA CUGAUGAGgccGUUAGGCCGAA IGGAGAGG | 5551 |
| 1284 | CUCUCCCC U GGCCCUGC | 5048 | GCAGGGCC CUGAUGAGgccGUUAGGCCGAA IGGGAGAG | 5552 |
| 1288 | CCCCUGGC C CUGCCCAG | 5049 | CUGGGCAG CUGAUGAGgccGUUAGGCCGAA ICCAGGGG | 5553 |
| 1289 | CCCUGGCC C UGCCCAGC | 5050 | GCUGGGCA CUGAUGAGgccGUUAGGCCGAA IGCCAGGG | 5554 |
| 1290 | CCUGGCCC U GCCCAGCC | 5051 | GGCUGGGC CUGAUGAGgccGUUAGGCCGAA IGGCCAGG | 5555 |
| 1293 | GGCCCUGC C CAGCCAGA | 5052 | UCUGGCUG CUGAUGAGgccGUUAGGCCGAA ICAGGGCC | 5556 |
| 1294 | GCCCUGCC C AGCCAGAG | 5053 | CUCUGGCU CUGAUGAGgccGUUAGGCCGAA IGCAGGGC | 5557 |
| 1295 | CCCUGCCC A GCCAGAGG | 5054 | CCUCUGGC CUGAUGAGgccGUUAGGCCGAA IGGCAGGG | 5558 |
| 1298 | UGCCCAGC C AGAGGAGG | 5055 | CCUCCUCU CUGAUGAGgccGUUAGGCCGAA ICUGGGCA | 5559 |
| 1299 | GCCCAGCC A GAGGAGGA | 5056 | UCCUCCUC CUGAUGAGgccGUUAGGCCGAA IGCUGGGC | 5560 |
| 1310 | GGAGGAGC C CCCCGAG | 5057 | CUCGGGGG CUGAUGAGgccGUUAGGCCGAA ICUCCUCC | 5561 |
| 1311 | GAGGAGCC C CCCGAGG | 5058 | CCUCGGGG CUGAUGAGgccGUUAGGCCGAA IGCUCCUC | 5562 |
| 1312 | AGGAGCCC C CCGAGGA | 5059 | UCCUCGGG CUGAUGAGgccGUUAGGCCGAA IGGCUCCU | 5563 |
| 1313 | GGAGCCCC C CGAGGAG | 5060 | CUCCUCGG CUGAUGAGgccGUUAGGCCGAA IGGGCUCC | 5564 |
| 1314 | GAGCCCCC C GAGGAGC | 5061 | GCUCCUCG CUGAUGAGgccGUUAGGCCGAA IGGGGCUC | 5565 |
| 1315 | AGCCCCCC C GAGGAGCC | 5062 | GGCUCCUC CUGAUGAGgccGUUAGGCCGAA IGGGGGCU | 5566 |
| 1323 | CGAGGAGC C ACCUGACU | 5063 | AGUCAGGU CUGAUGAGgccGUUAGGCCGAA ICUCCUCG | 5567 |
| 1324 | GAGGAGCC A CCUGACUU | 5064 | AAGUCAGG CUGAUGAGgccGUUAGGCCGAA IGCUCCUC | 5568 |
| 1326 | GGAGCCAC C UGACUUCU | 5065 | AGAAGUCA CUGAUGAGgccGUUAGGCCGAA IUGGCUCC | 5569 |
| 1327 | GAGCCACC U GACUUCUG | 5066 | CAGAAGUC CUGAUGAGgccGUUAGGCCGAA IGUGGCUC | 5570 |
| 1331 | CACCGAC U UCUGCUGU | 5067 | ACAGCAGA CUGAUGAGgccGUUAGGCCGAA IUCAGGUG | 5571 |
| 1334 | CUGACUUC U GCUGUCCC | 5068 | GGGACAGC CUGAUGAGgccGUUAGGCCGAA IAAGUCAG | 5572 |
| 1337 | ACUUCUGC U GUCCCAAG | 5069 | CUUGGGAC CUGAUGAGgccGUUAGGCCGAA ICAGAAGU | 5573 |
| 1341 | CUGCUGUC C CAAGUGCC | 5070 | GGCACUUG CUGAUGAGgccGUUAGGCCGAA IACAGCAG | 5574 |
| 1342 | UGCUGUCC C AAGUGCCA | 5071 | UGGCACUU CUGAUGAGgccGUUAGGCCGAA IGACAGCA | 5575 |
| 1343 | GCUGUCCC A AGUGCCAG | 5072 | CUGGCACU CUGAUGAGgccGUUAGGCCGAA IGGACAGC | 5576 |
| 1349 | CCAAGUGC C AGUAUCAG | 5073 | CUGAUACU CUGAUGAGgccGUUAGGCCGAA ICACUUGG | 5577 |
| 1350 | CAAGUGCC A GUAUCAGG | 5074 | CCUGAUAC CUGAUGAGgccGUUAGGCCGAA IGCACUUG | 5578 |
| 1356 | CCAGUAUC A GGCCCUG | 5075 | CAGGGCC CUGAUGAGgccGUUAGGCCGAA IAUACUGG | 5579 |
| 1360 | UAUCAGGC C CCUGAUAU | 5076 | AUAUCAGG CUGAUGAGgccGUUAGGCCGAA ICCUGAUA | 5580 |
| 1361 | AUCAGGCC C UGAUAUG | 5077 | CAUAUCAG CUGAUGAGgccGUUAGGCCGAA IGCCUGAU | 5581 |
| 1362 | UCAGGCCC U GAUAUGG | 5078 | CCAUAUCA CUGAUGAGgccGUUAGGCCGAA IGGCCUGA | 5582 |
| 1363 | CAGGCCCU U GAUAUGGA | 5079 | UCCAUAUC CUGAUGAGgccGUUAGGCCGAA IGGGCCUG | 5583 |
| 1373 | AUAUGGAC A CCCUGCAG | 5080 | CUGCAGGG CUGAUGAGgccGUUAGGCCGAA IUCCAUAU | 5584 |
| 1375 | AUGGACAC C CUGCAGAU | 5081 | AUCUGCAG CUGAUGAGgccGUUAGGCCGAA IUGUCCAU | 5585 |
| 1376 | UGGACACC C UGCAGAUA | 5082 | UAUCUGCA CUGAUGAGgccGUUAGGCCGAA IGUGUCCA | 5586 |
| 1377 | GGACACCU U GCAGAUAC | 5083 | GUAUCUGC CUGAUGAGgccGUUAGGCCGAA IGGUGUCC | 5587 |
| 1380 | CACCCUGC A GAUACAUG | 5084 | CAUGUAUC CUGAUGAGgccGUUAGGCCGAA ICAGGGUG | 5588 |
| 1386 | GCAGAUAC A UGUCAUGG | 5085 | CCAUGACA CUGAUGAGgccGUUAGGCCGAA IUAUCUGC | 5589 |
| 1391 | UACAUGUC A UGGAGUGC | 5086 | GCACUCCA CUGAUGAGgccGUUAGGCCGAA IACAUGUA | 5590 |
| 1400 | UGGAGUGC A UUGAGUAG | 5087 | CUACUCAA CUGAUGAGgccGUUAGGCCGAA ICACUCCA | 5591 |
| 1412 | AGUAGGGC C GGCCAGUG | 5088 | CACUGGCC CUGAUGAGgccGUUAGGCCGAA ICCCUACU | 5592 |
| 1416 | GGGCCGGC C AGUGCAAG | 5089 | CUUGCACU CUGAUGAGgccGUUAGGCCGAA ICCGGCCC | 5593 |
| 1417 | GGCCGGCC A GUGCAAGG | 5090 | CCUUGCAC CUGAUGAGgccGUUAGGCCGAA IGCCGGCC | 5594 |
| 1422 | GCCAGUGC A AGGCCACU | 5091 | AGUGGCCU CUGAUGAGgccGUUAGGCCGAA ICACUGGC | 5595 |
| 1427 | UGCAAGGC C ACUGCCUG | 5092 | CAGGCAGU CUGAUGAGgccGUUAGGCCGAA ICCUUGCA | 5596 |
| 1428 | GCAAGGCC A CUGCCUGC | 5093 | GCAGGCAG CUGAUGAGgccGUUAGGCCGAA IGCCUUGC | 5597 |
| 1430 | AAGGCCAC U GCCUGCCC | 5094 | GGGCAGGC CUGAUGAGgccGUUAGGCCGAA IUGGCCUU | 5598 |
| 1433 | GCCACUGC C UGCCCGAG | 5095 | CUCGGGCA CUGAUGAGgccGUUAGGCCGAA ICAGUGGC | 5599 |
| 1434 | CCACUGCU U GCCCGAGG | 5096 | CCUCGGGC CUGAUGAGgccGUUAGGCCGAA IGCAGUGG | 5600 |
| 1437 | CUGCCUGC C CGAGGACG | 5097 | CGUCCUCG CUGAUGAGgccGUUAGGCCGAA ICAGGCAG | 5601 |
| 1438 | UGCCUGCC C GAGGACGU | 5098 | ACGUCCUC CUGAUGAGgccGUUAGGCCGAA IGCAGGCA | 5602 |
| 1449 | GGACGUGC C CGGGACCG | 5099 | CGGUCCCG CUGAUGAGgccGUUAGGCCGAA ICACGUCC | 5603 |
| 1450 | GACGUGCC C GGGACCGU | 5100 | ACGGUCCC CUGAUGAGgccGUUAGGCCGAA IGCACGUC | 5604 |
| 1456 | CCCGGGAC C GUGCAGUC | 5101 | GACUGCAC CUGAUGAGgccGUUAGGCCGAA IUCCCGGG | 5605 |
| 1461 | GACCGUGC A GUCUGCGC | 5102 | GCGCAGAC CUGAUGAGgccGUUAGGCCGAA ICACGGUC | 5606 |
| 1465 | GUGCAGUC U GCGCUUUC | 5103 | GAAAGCGC CUGAUGAGgccGUUAGGCCGAA IACUGCAC | 5607 |
| 1470 | GUCUGCGC U UUCCUCUC | 5104 | GAGAGGAA CUGAUGAGgccGUUAGGCCGAA ICGCAGAC | 5608 |
| 1474 | GCGCUUUC C UCUCCGC | 5105 | GCGGGAGA CUGAUGAGgccGUUAGGCCGAA IAAAGCGC | 5609 |
| 1475 | CGCUUUCC U CUCCCGCC | 5106 | GGCGGGAG CUGAUGAGgccGUUAGGCCGAA IGAAAGCG | 5610 |
| 1477 | CUUUCCUC U CCCGCCUG | 5107 | CAGGCGGG CUGAUGAGgccGUUAGGCCGAA IAGGAAAG | 5611 |
| 1479 | UUCCUCUC C CGCUGCC | 5108 | GGCAGGCG CUGAUGAGgccGUUAGGCCGAA IAGAGGAA | 5612 |
| 1480 | UCCUCUCC C GCCUGCCU | 5109 | AGGCAGGC CUGAUGAGgccGUUAGGCCGAA IGAGAGGA | 5613 |
| 1483 | UCUCCCGC C UGCCUAGCC | 5110 | GCUAGGCA CUGAUGAGgccGUUAGGCCGAA ICGGGAGA | 5614 |
| 1484 | CUCCCGCC U GCCUAGCC | 5111 | GGCUAGGC CUGAUGAGgccGUUAGGCCGAA IGCGGGAG | 5615 |
| 1487 | CCGCCUGC C UAGCCCAG | 5112 | CUGGGCUA CUGAUGAGgccGUUAGGCCGAA ICAGGCGG | 5616 |
| 1488 | CGCCUGCU U AGCCCAGG | 5113 | CCUGGGCU CUGAUGAGgccGUUAGGCCGAA IGCAGGCG | 5617 |
| 1492 | UGCCUAGC C CAGGAUGA | 5114 | UCAUCCUG CUGAUGAGgccGUUAGGCCGAA ICUAGGCA | 5618 |

TABLE IV-continued

Human IKK-gamma Inozyme and Substrate Sequence

| Pos | Substrate | Seq ID | Inozyme | Seq ID |
|---|---|---|---|---|
| 1493 | GCCUAGCC C AGGAUGAA | 5115 | UUCAUCCU CUGAUGAGGCCGUUAGGCCGAA IGCUAGGC | 5619 |
| 1494 | CCUAGCCC A GGAUGAAG | 5116 | CUUCAUCC CUGAUGAGGCCGUUAGGCCGAA IGGCUAGG | 5620 |
| 1506 | UGAAGGGC U GGGUGGCC | 5117 | GGCCACCC CUGAUGAGGCCGUUAGGCCGAA ICCCUUCA | 5621 |
| 1514 | UGGGUGGC C ACAACUGG | 5118 | CCAGUUGU CUGAUGAGGCCGUUAGGCCGAA ICCACCCA | 5622 |
| 1515 | GGGUGGCC A CAACUGGG | 5119 | CCCAGUUG CUGAUGAGGCCGUUAGGCCGAA IGCCACCC | 5623 |
| 1517 | GUGGCCAC A ACUGGGAU | 5120 | AUCCCAGU CUGAUGAGGCCGUUAGGCCGAA IUGGCCAC | 5624 |
| 1520 | GCCACAAC U GGGAUGCC | 5121 | GGCAUCCC CUGAUGAGGCCGUUAGGCCGAA IUUGUGGC | 5625 |
| 1528 | UGGGAUGC C ACCUGGAG | 5122 | CUCCAGGU CUGAUGAGGCCGUUAGGCCGAA ICAUCCCA | 5626 |
| 1529 | GGGAUGCC A CCUGGAGC | 5123 | GCUCCAGG CUGAUGAGGCCGUUAGGCCGAA IGCAUCCC | 5627 |
| 1531 | GAUGCCAC C UGGAGCCC | 5124 | GGGCUCCA CUGAUGAGGCCGUUAGGCCGAA IUGGCAUC | 5628 |
| 1532 | AUGCCACC U GGAGCCCC | 5125 | GGGGCUCC CUGAUGAGGCCGUUAGGCCGAA IGUGGCAU | 5629 |
| 1538 | CCUGGAGC C CACCCAG | 5126 | CUGGGUGG CUGAUGAGGCCGUUAGGCCGAA ICUCCAGG | 5630 |
| 1539 | CUGGAGCC C ACCCAGG | 5127 | CCUGGGUG CUGAUGAGGCCGUUAGGCCGAA IGCUCCAG | 5631 |
| 1540 | UGGAGCCC C ACCCAGGA | 5128 | UCCUGGGU CUGAUGAGGCCGUUAGGCCGAA IGGCUCCA | 5632 |
| 1541 | GGAGCCCC A CCCAGGAG | 5129 | CUCCUGGG CUGAUGAGGCCGUUAGGCCGAA IGGGCUCC | 5633 |
| 1543 | AGCCCCAC C CAGGAGCU | 5130 | AGCUCCUG CUGAUGAGGCCGUUAGGCCGAA IUGGGGCU | 5634 |
| 1544 | GCCCCACC C AGGAGCUG | 5131 | CAGCUCCU CUGAUGAGGCCGUUAGGCCGAA IGUGGGGC | 5635 |
| 1545 | CCCCACCC A GGAGCUGG | 5132 | CCAGCUCC CUGAUGAGGCCGUUAGGCCGAA IGGUGGGG | 5636 |
| 1551 | CCAGGAGC U GGCCGCGG | 5133 | CCGCGGCC CUGAUGAGGCCGUUAGGCCGAA ICUCCUGG | 5637 |
| 1555 | GAGCUGGC C GCGGCACC | 5134 | GGUGCCGC CUGAUGAGGCCGUUAGGCCGAA ICCAGCUC | 5638 |
| 1561 | GCCGCGGC A CCUUACGC | 5135 | GCGUAAGG CUGAUGAGGCCGUUAGGCCGAA ICCGCGGC | 5639 |
| 1563 | CGCGGCAC C UUACGCUU | 5136 | AAGCGUAA CUGAUGAGGCCGUUAGGCCGAA IUGCCGCG | 5640 |
| 1564 | GCGGCACC U UACGCUUC | 5137 | GAAGCGUA CUGAUGAGGCCGUUAGGCCGAA IGUGCCGC | 5641 |
| 1570 | CCUUACGC U UCAGCUUG | 5138 | ACAGCUGA CUGAUGAGGCCGUUAGGCCGAA ICGUAAGG | 5642 |
| 1573 | UACGCUUC A GCUUGA | 5139 | UCAACAGC CUGAUGAGGCCGUUAGGCCGAA IAAGCGUA | 5643 |
| 1576 | GCUUCAGC U UGAUCC | 5140 | GGAUCAAC CUGAUGAGGCCGUUAGGCCGAA ICUGAAGC | 5644 |
| 1584 | UGUUGAUC C GCUGGUCC | 5141 | GGACCAGC CUGAUGAGGCCGUUAGGCCGAA IAUCAACA | 5645 |
| 1587 | UGAUCCGC U GGUCCCU | 5142 | AGGGGACC CUGAUGAGGCCGUUAGGCCGAA ICGGAUCA | 5646 |
| 1592 | CGCUGGUC C CCUCUUUU | 5143 | AAAAGAGG CUGAUGAGGCCGUUAGGCCGAA IACCAGCG | 5647 |
| 1593 | GCUGGUCC C CUCUUUUG | 5144 | CAAAAGAG CUGAUGAGGCCGUUAGGCCGAA IGACCAGC | 5648 |
| 1594 | CUGGUCCC C UCUUUUGG | 5145 | CCAAAAGA CUGAUGAGGCCGUUAGGCCGAA IGGACCAG | 5649 |
| 1595 | UGGUCCCC U CUUUUGGG | 5146 | CCCAAAAG CUGAUGAGGCCGUUAGGCCGAA IGGGACCA | 5650 |
| 1597 | GUCCCCUC U UUUGGGU | 5147 | ACCCCAAA CUGAUGAGGCCGUUAGGCCGAA IAGGGGAC | 5651 |
| 1615 | GAUGCGGC C CGAUCAG | 5148 | CUGAUCGG CUGAUGAGGCCGUUAGGCCGAA ICCGCAUC | 5652 |
| 1616 | AUGCGGCC C CGAUCAGG | 5149 | CCUGAUCG CUGAUGAGGCCGUUAGGCCGAA IGCCGCAU | 5653 |
| 1617 | UGCGGCCC C GAUCAGGC | 5150 | GCCUGAUC CUGAUGAGGCCGUUAGGCCGAA IGGCCGCA | 5654 |
| 1622 | CCCCGAUC A GGCCUGAC | 5151 | GUCAGGCC CUGAUGAGGCCGUUAGGCCGAA IAUCGGGG | 5655 |
| 1626 | GAUCAGGC C UGAUCGC | 5152 | GCGAGUCA CUGAUGAGGCCGUUAGGCCGAA ICCUGAUC | 5656 |
| 1627 | AUCAGGCC U GACUCGCU | 5153 | AGCGAGUC CUGAUGAGGCCGUUAGGCCGAA IGCCUGAU | 5657 |
| 1631 | GGCCUGAC U CGCUGCUC | 5154 | GAGCAGCG CUGAUGAGGCCGUUAGGCCGAA IUCAGGCC | 5658 |
| 1635 | UGACUCGC U GCUCUUUU | 5155 | AAAAGAGC CUGAUGAGGCCGUUAGGCCGAA ICGAGUCA | 5659 |
| 1638 | CUCGCUGC U CUUUUGU | 5156 | ACAAAAAG CUGAUGAGGCCGUUAGGCCGAA ICAGCGAG | 5660 |
| 1640 | CGCUGCUC U UUUGUUC | 5157 | GAACAAAA CUGAUGAGGCCGUUAGGCCGAA IAGCAGCG | 5661 |
| 1649 | UUUUGUUC C CUUCUGUC | 5158 | GACAGAAG CUGAUGAGGCCGUUAGGCCGAA IAACAAAA | 5662 |
| 1650 | UUUGUUCC C UUCUGUCU | 5159 | AGACAGAA CUGAUGAGGCCGUUAGGCCGAA IGAACAAA | 5663 |
| 1651 | UUGUUCCC U UCUGUCUG | 5160 | CAGACAGA CUGAUGAGGCCGUUAGGCCGAA IGGAACAA | 5664 |
| 1654 | UUCCCUUC U GUCUGCUC | 5161 | GAGCAGAC CUGAUGAGGCCGUUAGGCCGAA IAAGGGAA | 5665 |
| 1658 | CUUCUGUC U GCUCGAAC | 5162 | GUUCGAGC CUGAUGAGGCCGUUAGGCCGAA IACAGAAG | 5666 |
| 1661 | CUGUCUGC U CGAACCAC | 5163 | GUGGUUCG CUGAUGAGGCCGUUAGGCCGAA ICAGACAG | 5667 |
| 1667 | GCUCGAAC C ACUUGCCU | 5164 | AGGCAAGU CUGAUGAGGCCGUUAGGCCGAA IUUCGAGC | 5668 |
| 1668 | CUCGAACC A CUUGCCUC | 5165 | GAGGCAAG CUGAUGAGGCCGUUAGGCCGAA IGUUCGAG | 5669 |
| 1670 | CGAACCAC U UGCCUCGG | 5166 | CCGAGGCA CUGAUGAGGCCGUUAGGCCGAA IUGGUUCG | 5670 |
| 1674 | CCACUUGC C UCGGCUA | 5167 | UAGCCCGA CUGAUGAGGCCGUUAGGCCGAA ICAAGUGG | 5671 |
| 1675 | CACUUGCC U CGGCUAA | 5168 | UUAGCCCG CUGAUGAGGCCGUUAGGCCGAA IGCAAGUG | 5672 |
| 1681 | CCUCGGGC U AAUCCCUC | 5169 | GAGGGAUU CUGAUGAGGCCGUUAGGCCGAA ICCCGAGG | 5673 |
| 1686 | GGCUAAUC C CUCCCUCU | 5170 | AGAGGGAG CUGAUGAGGCCGUUAGGCCGAA IAUUAGCC | 5674 |
| 1687 | GCUAAUCC C UCCCUCUU | 5171 | AAGAGGGA CUGAUGAGGCCGUUAGGCCGAA IGAUUAGC | 5675 |
| 1688 | CUAAUCCC U CCCUCUUC | 5172 | GAAGAGGG CUGAUGAGGCCGUUAGGCCGAA IGGAUUAG | 5676 |
| 1690 | AAUCCCUC C UCUUCCU | 5173 | AGGAAGAG CUGAUGAGGCCGUUAGGCCGAA IAGGGAUU | 5677 |
| 1691 | AUCCCUCC U CUUCCUC | 5174 | GAGGAAGA CUGAUGAGGCCGUUAGGCCGAA IGAGGGAU | 5678 |
| 1692 | UCCCUCCU C UUCCUCC | 5175 | GGAGGAAG CUGAUGAGGCCGUUAGGCCGAA IGGAGGGA | 5679 |
| 1694 | CCUCCUCU U UCCUCCAC | 5176 | GUGGAGGA CUGAUGAGGCCGUUAGGCCGAA IAGGGAGG | 5680 |
| 1697 | CCCUCUUC U UCCACCCG | 5177 | CGGGUGGA CUGAUGAGGCCGUUAGGCCGAA IAAGAGGG | 5681 |
| 1698 | CCUCUUCU U CCACCCGG | 5178 | CCGGGUGG CUGAUGAGGCCGUUAGGCCGAA IGAAGAGG | 5682 |
| 1700 | UCUUCCUC C ACCCGGCA | 5179 | UGCCGGGU CUGAUGAGGCCGUUAGGCCGAA IAGGAAGA | 5683 |
| 1701 | CUUCCUCC A CCCGGCAC | 5180 | GUGCCGGG CUGAUGAGGCCGUUAGGCCGAA IGAGGAAG | 5684 |
| 1703 | UCCUCCAC C CGGCACUG | 5181 | CAGUGCCG CUGAUGAGGCCGUUAGGCCGAA IUGGAGGA | 5685 |
| 1704 | CCUCCACC C GGCACUGG | 5182 | CCAGUGCC CUGAUGAGGCCGUUAGGCCGAA IGUGGAGG | 5686 |
| 1708 | CACCCGGC A CUGGGAA | 5183 | UUCCCAGU CUGAUGAGGCCGUUAGGCCGAA ICCGGGUG | 5687 |
| 1710 | CCCGGCAC U GGGAAGU | 5184 | ACUUCCCC CUGAUGAGGCCGUUAGGCCGAA IUGCCGGG | 5688 |
| 1720 | GGGAAGUC A AGAAUGGG | 5185 | CCCAUUCU CUGAUGAGGCCGUUAGGCCGAA IACUUCCC | 5689 |
| 1731 | AAUGGGGC C UGGGGCUC | 5186 | GAGCCCCA CUGAUGAGGCCGUUAGGCCGAA ICCCCAUU | 5690 |
| 1732 | AUGGGGCC U GGGGCUCU | 5187 | AGAGCCCC CUGAUGAGGCCGUUAGGCCGAA ICCCCCAU | 5691 |
| 1738 | CCUGGGGC U CUCAGGGA | 5188 | UCCCUGAG CUGAUGAGGCCGUUAGGCCGAA ICCCCAGG | 5692 |

TABLE IV-continued

Human IKK-gamma Inozyme and Substrate Sequence

| Pos | Substrate | Seq ID | Inozyme | Seq ID |
|---|---|---|---|---|
| 1740 | UGGGGCUC U CAGGGAGA | 5189 | UCUCCCUG CUGAUGAGGCCGUUAGGCCGAA IAGCCCCA | 5693 |
| 1742 | GGGCUCUC A GGGAGAAC | 5190 | GUUCUCCC CUGAUGAGGCCGUUAGGCCGAA IAGAGCCC | 5694 |
| 1751 | GGGAGAAC U GCUUCCCC | 5191 | GGGGAAGC CUGAUGAGGCCGUUAGGCCGAA IUUCUCCC | 5695 |
| 1754 | AGAACUGC U UCCCCUGG | 5192 | CCAGGGGA CUGAUGAGGCCGUUAGGCCGAA ICAGUUCU | 5696 |
| 1757 | ACUGCUUC C CCUGGCAG | 5193 | CUGCCAGG CUGAUGAGGCCGUUAGGCCGAA IAAGCAGU | 5697 |
| 1758 | CUGCUUCC C CUGGCAGA | 5194 | UCUGCCAG CUGAUGAGGCCGUUAGGCCGAA IGAAGCAG | 5698 |
| 1759 | UGCUUCCC C UGGCAGAG | 5195 | CUCUGCCA CUGAUGAGGCCGUUAGGCCGAA IGGAAGCA | 5699 |
| 1760 | GCUUCCCC U GGCAGAGC | 5196 | GCUCUGCC CUGAUGAGGCCGUUAGGCCGAA IGGGAAGC | 5700 |
| 1764 | CCCCUGGC A GAGCUGGG | 5197 | CCCAGCUC CUGAUGAGGCCGUUAGGCCGAA ICCAGGGG | 5701 |
| 1769 | GGCAGAGC U GGGUGGCA | 5198 | UGCCACCC CUGAUGAGGCCGUUAGGCCGAA ICUCUGCC | 5702 |
| 1777 | UGGGUGGC A GCUCUUCC | 5199 | GGAAGAGC CUGAUGAGGCCGUUAGGCCGAA ICCACCCA | 5703 |
| 1780 | GUGGCAGC U CUUCCUCC | 5200 | GGAGGAAG CUGAUGAGGCCGUUAGGCCGAA ICUGCCAC | 5704 |
| 1782 | GGCAGCUC U CCUCCCA | 5201 | UGGGAGGA CUGAUGAGGCCGUUAGGCCGAA IAGCUGCC | 5705 |
| 1785 | AGCUCUUC C UCCCACCG | 5202 | CGGUGGGA CUGAUGAGGCCGUUAGGCCGAA IAAGAGCU | 5706 |
| 1786 | GCUCUUCC U CCCACCGG | 5203 | CCGGUGGG CUGAUGAGGCCGUUAGGCCGAA IGAAGAGC | 5707 |
| 1788 | UCUUCCUC C CACCGGAC | 5204 | GUCCGGUG CUGAUGAGGCCGUUAGGCCGAA IAGGAAGA | 5708 |
| 1789 | CUUCCUCC C ACCGGACA | 5205 | UGUCCGGU CUGAUGAGGCCGUUAGGCCGAA IGAGGAAG | 5709 |
| 1790 | UUCCUCCC A CCGGACAC | 5206 | GUGUCCGG CUGAUGAGGCCGUUAGGCCGAA IGGACGAA | 5710 |
| 1792 | CCUCCCAC C GGACACCG | 5207 | CGGUGUCC CUGAUGAGGCCGUUAGGCCGAA IUGGGAGG | 5711 |
| 1797 | CACCGGAC A CCGACCCG | 5208 | CGGGUCGG CUGAUGAGGCCGUUAGGCCGAA IUCCGGUG | 5712 |
| 1799 | CCGGACAC C GACCCGCC | 5209 | GGCGGGUC CUGAUGAGGCCGUUAGGCCGAA IUGUCCGG | 5713 |
| 1803 | ACACCGAC C CGCCCGCC | 5210 | GGCGGGCG CUGAUGAGGCCGUUAGGCCGAA IUCGGUGU | 5714 |
| 1804 | CACCGACC C GCCCGCCG | 5211 | CGGCGGGC CUGAUGAGGCCGUUAGGCCGAA IGUCGGUG | 5715 |
| 1807 | CGACCCGC C CGCCGCUG | 5212 | CAGCGGCG CUGAUGAGGCCGUUAGGCCGAA ICGGGUCG | 5716 |
| 1808 | GACCCGCC C GCCGCUGU | 5213 | ACAGCGGC CUGAUGAGGCCGUUAGGCCGAA IGCGGGUC | 5717 |
| 1811 | CCGCCCGC C GCUGUGCC | 5214 | GGCACAGC CUGAUGAGGCCGUUAGGCCGAA ICGGGCGG | 5718 |
| 1814 | CCCGCCGC U GUGCCCUG | 5215 | CAGGGCAC CUGAUGAGGCCGUUAGGCCGAA ICGGCGGG | 5719 |
| 1819 | CGCUGUGC C CUGGGAGU | 5216 | ACUCCCAG CUGAUGAGGCCGUUAGGCCGAA ICACAGCG | 5720 |
| 1820 | GCUGUGCC C UGGGAGUG | 5217 | CACUCCCA CUGAUGAGGCCGUUAGGCCGAA IGCACAGC | 5721 |
| 1821 | CUGUGCCC U GGGAGUGC | 5218 | GCACUCCC CUGAUGAGGCCGUUAGGCCGAA IGGCACAG | 5722 |
| 1830 | GGGAGUGC U GCCCUCUU | 5219 | AAGAGGGC CUGAUGAGGCCGUUAGGCCGAA ICACUCCC | 5723 |
| 1833 | AGUGCUGC C CUCUUACC | 5220 | GGUAAGAG CUGAUGAGGCCGUUAGGCCGAA ICAGCACU | 5724 |
| 1834 | GUGCUGCC C UCUUACCA | 5221 | UGGUAAGA CUGAUGAGGCCGUUAGGCCGAA IGCAGCAC | 5725 |
| 1835 | UGCUGCCC U CUUACCAU | 5222 | AUGGUAAG CUGAUGAGGCCGUUAGGCCGAA IGGCAGCA | 5726 |
| 1837 | CUGCCCUC U UACCAUGC | 5223 | GCAUGGUA CUGAUGAGGCCGUUAGGCCGAA IAGGGCAG | 5727 |
| 1841 | CCUCUUAC C AUGCACAC | 5224 | GUGUGCAU CUGAUGAGGCCGUUAGGCCGAA IUAAGAGG | 5728 |
| 1842 | CUCUUACC A UGCACACG | 5225 | CGUGUGCA CUGAUGAGGCCGUUAGGCCGAA IGUAAGAG | 5729 |
| 1846 | UACCAUGC A CACGGGUG | 5226 | CACCCGUG CUGAUGAGGCCGUUAGGCCGAA ICAUGGUA | 5730 |
| 1848 | CCAUGCAC A CGGGUGCU | 5227 | AGCACCCG CUGAUGAGGCCGUUAGGCCGAA IUGCAUGG | 5731 |
| 1856 | ACGGGUGC U CUCCUUUU | 5228 | AAAAGGAG CUGAUGAGGCCGUUAGGCCGAA ICACCCGU | 5732 |
| 1858 | GGGUGCUC U CCUUUUGG | 5229 | CCAAAAGG CUGAUGAGGCCGUUAGGCCGAA IAGCACCC | 5733 |
| 1860 | GUGCUCUC C UUUUGGGC | 5230 | GCCCAAAA CUGAUGAGGCCGUUAGGCCGAA IAGAGCAC | 5734 |
| 1861 | UGCUCUCC U UUUGGGCU | 5231 | AGCCCAAA CUGAUGAGGCCGUUAGGCCGAA IGAGAGCA | 5735 |
| 1869 | UUUUGGGC U GCAUGCUA | 5232 | UAGCAUGC CUGAUGAGGCCGUUAGGCCGAA ICCCAAAA | 5736 |
| 1872 | UGGGCUGC A UGCUAUUC | 5233 | GAAUAGCA CUGAUGAGGCCGUUAGGCCGAA ICAGCCCA | 5737 |
| 1876 | CUGCAUGC U AUUCCAUU | 5234 | AAUGGAAU CUGAUGAGGCCGUUAGGCCGAA ICAUGCAG | 5738 |
| 1881 | UGCUAUUC C AUUUGCA | 5235 | UGCAAAAU CUGAUGAGGCCGUUAGGCCGAA IAAUAGCA | 5739 |
| 1882 | GCUAUUCC A UUUGCAG | 5236 | CUGCAAAA CUGAUGAGGCCGUUAGGCCGAA IGAAUAGC | 5740 |
| 1889 | CAUUUGC A GCCAGACC | 5237 | GGUCUGGC CUGAUGAGGCCGUUAGGCCGAA ICAAAAUG | 5741 |
| 1892 | UUUGCAGC C AGACCGAU | 5238 | AUCGGUCU CUGAUGAGGCCGUUAGGCCGAA ICUGCAAA | 5742 |
| 1893 | UUGCAGCC A GACCGAUG | 5239 | CAUCGGUC CUGAUGAGGCCGUUAGGCCGAA IGCUGCAA | 5743 |
| 1897 | AGCCAGAC C GAUGUGUA | 5240 | UACACAUC CUGAUGAGGCCGUUAGGCCGAA IUCUGGCU | 5744 |
| 1912 | UAUUUAAC C AGUCACUA | 5241 | UAGUCACU CUGAUGAGGCCGUUAGGCCGAA IUUAAAUA | 5745 |
| 1913 | AUUUAACC A GUCACUAU | 5242 | AUAGUGAC CUGAUGAGGCCGUUAGGCCGAA IGUUAAAU | 5746 |
| 1917 | AACCAGUC A CUAUUGAU | 5243 | AUCAAUAG CUGAUGAGGCCGUUAGGCCGAA IACUGGUU | 5747 |
| 1919 | CCAGUCAC U AUUGAUGG | 5244 | CCAUCAAU CUGAUGAGGCCGUUAGGCCGAA IUGACUGG | 5748 |
| 1930 | UGAUGGAC A UUUGGGUU | 5245 | AACCCAAA CUGAUGAGGCCGUUAGGCCGAA IUCCAUCA | 5749 |
| 1944 | GUUGUUUC C CAUCUUUU | 5246 | AAAAGAUG CUGAUGAGGCCGUUAGGCCGAA IAAACAAC | 5750 |
| 1945 | UUGUUUCC C AUCUUUUU | 5247 | AAAAAGAU CUGAUGAGGCCGUUAGGCCGAA IGAAACAA | 5751 |
| 1946 | UGUUUCCC A UCUUUUUG | 5248 | CAAAAAGA CUGAUGAGGCCGUUAGGCCGAA IGGAAACA | 5752 |
| 1949 | UUCCCAUC U UUUUGUUA | 5249 | UAACAAAA CUGAUGAGGCCGUUAGGCCGAA IAUGGGAA | 5753 |
| 1959 | UUUGUUAC C AUAAAUAA | 5250 | UUAUUUAU CUGAUGAGGCCGUUAGGCCGAA IUAACAAA | 5754 |
| 1960 | UUGUUACC A UAAAUAAU | 5251 | AUUAUUUA CUGAUGAGGCCGUUAGGCCGAA IGUAACAA | 5755 |
| 1972 | AUAAUGGC A UAGUAAAA | 5252 | UUUUACUA CUGAUGAGGCCGUUAGGCCGAA ICCAUUAU | 5756 |

Input Sequence NM_003639. Cut Site = CH/.
Arm Length = 8. Core Sequence CUGAUGAG GCCGUUAGGC CGAA
NM_003639 (*Homo sapiens* inhibitor of kappa light polypeptide gene enhancer in B-cells, kinase gamma (IKBKG), mRNA.; 1994 bp)

Underlined region can be any X sequence or linker, as described herein. "I" stands for Inosine.

TABLE V

Human IKK-gamma Zinzyme and Substrate Sequence

| Pos | Substrate | Seq ID | Zinzyme | Seq ID |
|---|---|---|---|---|
| 13 | CGAGCAUG G CCCUUGUG | 5757 | CACAAGGG GCCGAAAGGCGAGUGAGGUCU CAUGCUCG | 6034 |
| 19 | UGGCCCUU G UGAUCCAG | 5758 | CUGGAUCA GCCGAAAGGCGAGUGAGGUCU AAGGGCCA | 6035 |
| 28 | UGAUCCAG G UGGGGAAA | 5759 | UUUCCCCA GCCGAAAGGCGAGUGAGGUCU CUGGAUCA | 6036 |
| 42 | AAACUAAG G CCCAGAGA | 5760 | UCUCUGGG GCCGAAAGGCGAGUGAGGUCU CUUAGUUU | 6037 |
| 52 | CCAGAGAA G UGAGGACC | 5761 | GGUCCUCA GCCGAAAGGCGAGUGAGGUCU UUCUCUGG | 6038 |
| 63 | AGGACCCC G CAGACUAU | 5762 | AUAGUCUG GCCGAAAGGCGAGUGAGGUCU GGGGUCCU | 6039 |
| 80 | CAAUCCCA G UCUCUUCC | 5763 | GGAAGAGA GCCGAAAGGCGAGUGAGGUCU UGGGAUUG | 6040 |
| 100 | CACUCCCU G UGAAGCUC | 5764 | GAGCUUCA GCCGAAAGGCGAGUGAGGUCU AGGGAGUG | 6041 |
| 105 | CCUGUGAA G CUCUCCAG | 5765 | CUGGAGAG GCCGAAAGGCGAGUGAGGUCU UUCACAGG | 6042 |
| 113 | GCUCUCCA G CAUCAUCG | 5766 | CGAUGAUG GCCGAAAGGCGAGUGAGGUCU UGGAGAGC | 6043 |
| 124 | UCAUCGAG G UCCCAUCA | 5767 | UGAUGGGA GCCGAAAGGCGAGUGAGGUCU CUCGAUGA | 6044 |
| 133 | UCCCAUCA G CCCUUGCC | 5768 | GGCAAGGG GCCGAAAGGCGAGUGAGGUCU UGAUGGGA | 6045 |
| 139 | CAGCCCUU G CCCUGUUG | 5769 | CAACAGGG GCCGAAAGGCGAGUGAGGUCU AAGGGCUG | 6046 |
| 144 | CUUGCCCU G UUGGAUGA | 5770 | UCAUCCAA GCCGAAAGGCGAGUGAGGUCU AGGGCAAG | 6047 |
| 157 | AUGAAUAG G CACCUCUG | 5771 | CAGAGGUG GCCGAAAGGCGAGUGAGGUCU CUAUUCAU | 6048 |
| 171 | CUGGAAGA G CCAACUGU | 5772 | ACAGUUGG GCCGAAAGGCGAGUGAGGUCU UCUUCCAG | 6049 |
| 178 | AGCCAACU G UGUGAGAU | 5773 | AUCUCACA GCCGAAAGGCGAGUGAGGUCU AGUUGGCU | 6050 |
| 180 | CCAACUGU G UGAGAUGG | 5774 | CCAUCUCA GCCGAAAGGCGAGUGAGGUCU ACAGUUGG | 6051 |
| 188 | GUGAGAUG G UGCAGCCC | 5775 | GGGCUGCA GCCGAAAGGCGAGUGAGGUCU CAUCUCAC | 6052 |
| 190 | GAGAUGGU G CAGCCCAG | 5776 | CUGGGCUG GCCGAAAGGCGAGUGAGGUCU ACCAUCUC | 6053 |
| 193 | AUGGUGCA G CCCAGUGG | 5777 | CCACUGGG GCCGAAAGGCGAGUGAGGUCU UGCACCAU | 6054 |
| 198 | GCAGCCCA G UGGUGGCC | 5778 | GGCCACCA GCCGAAAGGCGAGUGAGGUCU UGGGCUGC | 6055 |
| 201 | GCCCAGUG G UGGCCCGG | 5779 | CCGGGCCA GCCGAAAGGCGAGUGAGGUCU CACUGGGC | 6056 |
| 204 | CAGUGGUG G CCCGGCAG | 5780 | CUGCCGGG GCCGAAAGGCGAGUGAGGUCU CACCACUG | 6057 |
| 209 | GUGGCCCG G CAGCAGAU | 5781 | AUCUGCUG GCCGAAAGGCGAGUGAGGUCU CGGGCCAC | 6058 |
| 212 | GCCCGGCA G CAGAUCAG | 5782 | CUGAUCUG GCCGAAAGGCGAGUGAGGUCU UGCCGGGC | 6059 |
| 224 | AUCAGGAC G UACUGGGC | 5783 | GCCCAGUA GCCGAAAGGCGAGUGAGGUCU GUCCUGAU | 6060 |
| 231 | CGUACUGG G CGAAGAGU | 5784 | ACUCUUCG GCCGAAAGGCGAGUGAGGUCU CCAGUACG | 6061 |
| 238 | GGCGAAGA G UCUCCUCU | 5785 | AGAGGAGA GCCGAAAGGCGAGUGAGGUCU UCUUCGCC | 6062 |
| 253 | CUGGGGAA G CCAGCCAU | 5786 | AUGGCUGG GCCGAAAGGCGAGUGAGGUCU UUCCCCAG | 6063 |
| 257 | GGAAGCCA G CCAUGCUG | 5787 | CAGCAUGG GCCGAAAGGCGAGUGAGGUCU UGGCUUCC | 6064 |
| 262 | CCAGCCAU G CUGCACCU | 5788 | AGGUGCAG GCCGAAAGGCGAGUGAGGUCU AUGGCUGG | 6065 |
| 265 | GCCAUGCU G CACCGCC | 5789 | GGCAGGUG GCCGAAAGGCGAGUGAGGUCU AGCAUGGC | 6066 |
| 271 | CUGCACCU G CCUUCAGA | 5790 | UCUGAAGG GCCGAAAGGCGAGUGAGGUCU AGGUGCAG | 6067 |
| 285 | AGAACAGG G CGCUCCUG | 5791 | CAGGAGCG GCCGAAAGGCGAGUGAGGUCU CCUGUUCU | 6068 |
| 287 | AACAGGGC G CUCCUGAG | 5792 | CUCAGGAG GCCGAAAGGCGAGUGAGGUCU GCCCGUU | 6069 |
| 304 | ACCCUCCA G CGCUGCCU | 5793 | AGGCAGCG GCCGAAAGGCGAGUGAGGUCU UGGAGGGU | 6070 |
| 306 | CCUCCAGC G CUGCCUGG | 5794 | CCAGGCAG GCCGAAAGGCGAGUGAGGUCU GCUGGAGG | 6071 |
| 309 | CCAGCGCU G CCUGGAGG | 5795 | CCUCCAGG GCCGAAAGGCGAGUGAGGUCU AGCGCUGG | 6072 |
| 328 | AAUCAAGA G CUCCGAGA | 5796 | UCUCGGAG GCCGAAAGGCGAGUGAGGUCU UCUUGAUU | 6073 |
| 338 | UCCGAGAU G CCAUCCGG | 5797 | CCGGAUGG GCCGAAAGGCGAGUGAGGUCU AUCUCGGA | 6074 |
| 346 | GCCAUCCG G CAGAGCAA | 5798 | UUGCUCUG GCCGAAAGGCGAGUGAGGUCU CGGAUGGC | 6075 |
| 351 | CCGGCAGA G CAACCAGA | 5799 | UCUGGUUG GCCGAAAGGCGAGUGAGGUCU UCUGCCGG | 6076 |
| 364 | CAGAUUCU G CGGGAGCG | 5800 | CGCUCCCG GCCGAAAGGCGAGUGAGGUCU AGAAUCUG | 6077 |
| 370 | CUGCGGGA G CGCUGCGA | 5801 | UCGCAGCG GCCGAAAGGCGAGUGAGGUCU UCCCGCAG | 6078 |
| 372 | GCGGGAGC G CUGCGAGG | 5802 | CCUCGCAG GCCGAAAGGCGAGUGAGGUCU GCUCCCGC | 6079 |
| 375 | GGAGCGCU G CGAGGAGC | 5803 | GCUCCUCG GCCGAAAGGCGAGUGAGGUCU AGCGCUCC | 6080 |
| 382 | UGCGAGGA G CUUCUGCA | 5804 | UGCAGAAG GCCGAAAGGCGAGUGAGGUCU UCCUCGCA | 6081 |
| 388 | GAGCUUCU G CAUUUCCA | 5805 | UGGAAAUG GCCGAAAGGCGAGUGAGGUCU AGAAGCUC | 6082 |
| 398 | AUUUCCAA G CCAGCCAG | 5806 | CUGGCUGG GCCGAAAGGCGAGUGAGGUCU UUGGAAAU | 6083 |
| 402 | CCAAGCCA G CCAGAGGG | 5807 | CCCUCUGG GCCGAAAGGCGAGUGAGGUCU UGGCUUGG | 6084 |
| 421 | GAGAAGGA G UUCCUCAU | 5808 | AUGAGGAA GCCGAAAGGCGAGUGAGGUCU UCCUUCUC | 6085 |
| 430 | UUCCUCAU G UGCAAGUU | 5809 | AACUUGCA GCCGAAAGGCGAGUGAGGUCU AUGAGGAA | 6086 |
| 432 | CCUCAUGU G CAAGUUCC | 5810 | GGAACUUG GCCGAAAGGCGAGUGAGGUCU ACAUGAGG | 6087 |
| 436 | AUGUGCAA G UUCAGGA | 5811 | UCCUGGAA GCCGAAAGGCGAGUGAGGUCU UUGCACAU | 6088 |
| 446 | UCCAGGAG G CCAGGAAA | 5812 | UUUCCUGG GCCGAAAGGCGAGUGAGGUCU CUCCUGGA | 6089 |
| 458 | GGAAACUG G UGGAGAGA | 5813 | UCUCUCCA GCCGAAAGGCGAGUGAGGUCU CAGUUUCC | 6090 |
| 471 | GAGACUCG G CCUGGAGA | 5814 | UCUCCAGG GCCGAAAGGCGAGUGAGGUCU CGAGUCUC | 6091 |
| 481 | CUGGAGAA G CUCGAUCU | 5815 | AGAUCGAG GCCGAAAGGCGAGUGAGGUCU UUCUCCAG | 6092 |
| 496 | CUGAGAG G CAGAAGGA | 5816 | UCCUUCUG GCCGAAAGGCGAGUGAGGUCU CUCUUCAG | 6093 |
| 505 | CAGAAGGA G CAGGCUCU | 5817 | AGAGCCUG GCCGAAAGGCGAGUGAGGUCU UCCUUCUG | 6094 |
| 509 | AGGAGCAG G CUCUGCGG | 5818 | CCGCAGAG GCCGAAAGGCGAGUGAGGUCU CUGCUCCU | 6095 |
| 514 | CAGGCUCU G CGGGAGGU | 5819 | ACCUCCCG GCCGAAAGGCGAGUGAGGUCU AGAUCCUG | 6096 |
| 521 | UGCGGGAG G UGGAUCAC | 5820 | GUGCUCCA GCCGAAAGGCGAGUGAGGUCU CUCCCGCA | 6097 |
| 526 | GAGGUGGA G CACCUGAA | 5821 | UUCAGGUG GCCGAAAGGCGAGUGAGGUCU UCCACCUC | 6098 |
| 540 | GAAGAGAU G CCAGCAGC | 5822 | GCUGCUGG GCCGAAAGGCGAGUGAGGUCU AUCUCUUC | 6099 |
| 544 | AGAUGCCA G CAGCAGAU | 5823 | AUCUGCUG GCCGAAAGGCGAGUGAGGUCU UGGCAUCU | 6100 |
| 547 | UGCCAGCA G CAGAUGGC | 5824 | GCCAUCUG GCCGAAAGGCGAGUGAGGUCU UGCUGGCA | 6101 |
| 554 | AUCAGAUG G CUGAGGAC | 5825 | GUCCUCAG GCCGAAAGGCGAGUGAGGUCU CAUCUGCU | 6102 |
| 566 | AGGACAAG G CCUCUGUG | 5826 | CACAGAGG GCCGAAAGGCGAGUGAGGUCU CUUGUCCU | 6103 |
| 572 | AGGCCUCU G UGAAAGCC | 5827 | GGCUUUCA GCCGAAAGGCGAGUGAGGUCU AGAGGCCU | 6104 |
| 578 | CUGUGAAA G CCCAGGUG | 5828 | CACCUGGG GCCGAAAGGCGAGUGAGGUCU UUUCACAG | 6105 |
| 584 | AAGCCCAG G UGACGUCC | 5829 | GGACGUCA GCCGAAAGGCGAGUGAGGUCU CUGGGCUU | 6106 |
| 589 | CAGGUGAC G UCCUUGCU | 5830 | AGCAAGGA GCCGAAAGGCGAGUGAGGUCU GUCACCUG | 6107 |

TABLE V-continued

Human IKK-gamma Zinzyme and Substrate Sequence

| Pos | Substrate | Seq ID | Zinzyme | Seq ID |
|-----|-----------|--------|---------|--------|
| 595 | ACGUCCUU G CUCGGGGA | 5831 | UCCCCGAG GCCGAAAGGCGAGUGAGGUCU AAGGACGU | 6108 |
| 604 | CUCGGGGA G CUGCAGGA | 5832 | UCCUGCAG GCCGAAAGGCGAGUGAGGUCU UCCCCGAG | 6109 |
| 607 | GGGGAGCU G CAGGAGAG | 5833 | CUCUCCUG GCCGAAAGGCGAGUGAGGUCU AGCUCCCC | 6110 |
| 615 | GCAGGAGA G CCAGAGUC | 5834 | GACUCUGG GCCGAAAGGCGAGUGAGGUCU UCUCCUGC | 6111 |
| 621 | GAGCCAGA G UCGCUUGG | 5835 | CCAAGCGA GCCGAAAGGCGAGUGAGGUCU UCUGUCUC | 6112 |
| 624 | CCAGAGUC G CUUGGAGG | 5836 | CCUCCAAG GCCGAAAGGCGAGUGAGGUCU GACUCUGG | 6113 |
| 632 | GCUUGGAG G CUGCCACU | 5837 | AGUGUCAG GCCGAAAGGCGAGUGAGGUCU CUCCAAGC | 6114 |
| 635 | UGGAGGCU G CCACUAAG | 5838 | CUUAGUGG GCCGAAAGGCGAGUGAGGUCU AGCCUCCA | 6115 |
| 648 | UAAGGAAU G CCAGGCUC | 5839 | GAGCCUGG GCCGAAAGGCGAGUGAGGUCU AUUCCUUA | 6116 |
| 653 | AAUGCCAG G CUCUGGAG | 5840 | CUCCAGAG GCCGAAAGGCGAGUGAGGUCU CUGGCAUU | 6117 |
| 663 | UCUGGAGG G UCGGGCCC | 5841 | GGGCCCGA GCCGAAAGGCGAGUGAGGUCU CCUCCAGA | 6118 |
| 668 | AGGGUCGG G CCCGGGCG | 5842 | CGCCCGGG GCCGAAAGGCGAGUGAGGUCU CCGACCCU | 6119 |
| 674 | GGGCCCGG G CGGCCAGC | 5843 | GCUGGCCG GCCGAAAGGCGAGUGAGGUCU CCGGGCCC | 6120 |
| 677 | CCCGGGCG G CCACGCAG | 5844 | CUCGCUGG GCCGAAAGGCGAGUGAGGUCU CGCCCGGG | 6121 |
| 681 | GGCGGCCA G CGAGCAGG | 5845 | CCUGCUCG GCCGAAAGGCGAGUGAGGUCU UGGCCGCC | 6122 |
| 685 | GCCAGCGA G CAGGCGCG | 5846 | CGCGCCUG GCCGAAAGGCGAGUGAGGUCU UCGCUGGC | 6123 |
| 689 | GCGAGCAG G CGCGGCAG | 5847 | CUGCCGCG GCCGAAAGGCGAGUGAGGUCU CUGCUCGC | 6124 |
| 691 | GAGCAGGC G CGGCAGCU | 5848 | AGCUGCCG GCCGAAAGGCGAGUGAGGUCU GCCUGCUC | 6125 |
| 694 | CAGGCGCG G CAGCUGGA | 5849 | UCCAGCUG GCCGAAAGGCGAGUGAGGUCU CGCGCCUG | 6126 |
| 697 | GCGCGGCA G CUGGAGAG | 5850 | CUCUCCAG GCCGAAAGGCGAGUGAGGUCU UGCCGCUG | 6127 |
| 705 | GCUGGAGA G UGAGCGCG | 5851 | CGCGCUCA GCCGAAAGGCGAGUGAGGUCU UCUCCAGC | 6128 |
| 709 | GAGAGUGA G CGCGAGGC | 5852 | GCCUCGCG GCCGAAAGGCGAGUGAGGUCU UCACUCUC | 6129 |
| 711 | GAGUGAGC G CGAGGCGC | 5853 | GCGCCUCG GCCGAAAGGCGAGUGAGGUCU GCUCACUC | 6130 |
| 716 | AGCGCGAG G CGCUGCAG | 5854 | CUGCAGCG GCCGAAAGGCGAGUGAGGUCU CUCGCGCU | 6131 |
| 718 | CGCGAGGC G CUGCAGCA | 5855 | UGCUGCAG GCCGAAAGGCGAGUGAGGUCU GCCUCGCG | 6132 |
| 721 | GAGGCGCU G CAGCAGCA | 5856 | UGCUGCUG GCCGAAAGGCGAGUGAGGUCU AGCGCCUC | 6133 |
| 724 | GCGCUGCA G CAGCAGCA | 5857 | UGCUGCUG GCCGAAAGGCGAGUGAGGUCU UGCAGCGC | 6134 |
| 727 | CUGCAGCA G CAGCACAG | 5858 | CUGUGCUG GCCGAAAGGCGAGUGAGGUCU UGCUGCAG | 6135 |
| 730 | CAGCAGCA G CACAGCGU | 5859 | ACGCUGUG GCCGAAAGGCGAGUGAGGUCU UGCUGCUG | 6136 |
| 735 | GCAGCACA G CGUGCAGG | 5860 | CCUGCACG GCCGAAAGGCGAGUGAGGUCU UGUGCUGC | 6137 |
| 737 | AGCACAGC G UGCAGGUG | 5861 | CACCUGCA GCCGAAAGGCGAGUGAGGUCU GCUGUGCU | 6138 |
| 739 | CACAGCGU G CAGGUGGA | 5862 | UCCACCUG GCCGAAAGGCGAGUGAGGUCU ACGCUGUG | 6139 |
| 743 | GCGUGCAG G UGGACCAG | 5863 | CUGGUCCA GCCGAAAGGCGAGUGAGGUCU CUGCACGC | 6140 |
| 751 | GUGGACCA G CUGCGCAU | 5864 | AUGCGCAG GCCGAAAGGCGAGUGAGGUCU UGGUCCAC | 6141 |
| 754 | GACCAGCU G CGCAUGCA | 5865 | UGCAUGCG GCCGAAAGGCGAGUGAGGUCU AGCUGGUC | 6142 |
| 756 | CCAGCUGC G CAUGCAGG | 5866 | CCUGCAUG GCCGAAAGGCGAGUGAGGUCU GCAGCUGG | 6143 |
| 760 | CUGCGCAU G CAGGGCCA | 5867 | UGGCCCUG GCCGAAAGGCGAGUGAGGUCU AUGCGCAG | 6144 |
| 765 | CAUGCAGG G CCAGAGCG | 5868 | CGCUCUGG GCCGAAAGGCGAGUGAGGUCU CCUGCAUG | 6145 |
| 771 | GGGCCAGA G CGUGGAGG | 5869 | CCUCCACG GCCGAAAGGCGAGUGAGGUCU UCUGGCCC | 6146 |
| 773 | GCCAGAGC G UGGAGGCC | 5870 | GGCCUCCA GCCGAAAGGCGAGUGAGGUCU GCUCUGGC | 6147 |
| 779 | GCGUGGAG G CCGCGCUC | 5871 | GAGCGCGG GCCGAAAGGCGAGUGAGGUCU CUCCACGC | 6148 |
| 782 | UGGAGGCC G CGCUCCGC | 5872 | GCGGAGCG GCCGAAAGGCGAGUGAGGUCU GGCCUCCA | 6149 |
| 784 | GACGCCGC G CUCCGCAU | 5873 | AUGCGGAG GCCGAAAGGCGAGUGAGGUCU GCGGCCUC | 6150 |
| 789 | CGCGCUCC G CAUGGAGC | 5874 | GCUCCAUG GCCGAAAGGCGAGUGAGGUCU GGACCGCG | 6151 |
| 796 | CGCAUGGA G CGCCAGGC | 5875 | GCCUGGCG GCCGAAAGGCGAGUGAGGUCU UCCAUCCG | 6152 |
| 798 | CAUGGAGC G CCAGCCCG | 5876 | CGGGCUGG GCCGAAAGGCGAGUGAGGUCU GCUCCAUG | 6153 |
| 803 | AGCGCCAC G CCGCCUCG | 5877 | CGAGCCGG GCCGAAAGGCGAGUGAGGUCU CUGGCGCU | 6154 |
| 806 | GCCCAGGC G CCUCGGAG | 5878 | CUCCGAGG GCCGAAAGGCGAGUGAGGUCU GCCCUGGC | 6155 |
| 826 | AAGAGGAA G CUGGCCAG | 5879 | UGGGCCAG GCCGAAAGGCGAGUGAGGUCU UUCCUCUU | 6156 |
| 830 | GGAAGCUG G CCCAGUUG | 5880 | CAACUGGG GCCGAAAGGCGAGUGAGGUCU CAGCUUCC | 6157 |
| 835 | CUGGCCCA G UUGCAGGU | 5881 | ACCUGCAA GCCGAAAGGCGAGUGAGGUCU UGGGCCAG | 6158 |
| 838 | GCCCAGUU G CAGGUGGC | 5882 | GCCACCUG GCCGAAAGGCGAGUGAGGUCU AACUGGGC | 6159 |
| 842 | AGUUGCAG G UGGCCUAU | 5883 | AUAGGCCA GCCGAAAGGCGAGUGAGGUCU CUGCAACU | 6160 |
| 845 | UGCAGGUG G CCUAUCAC | 5884 | GUGAUAGG GCCGAAAGGCGAGUGAGGUCU CACCUGCA | 6161 |
| 856 | UAUCACCA G CUCUUCCA | 5885 | UGGAAGAG GCCGAAAGGCGAGUGAGGUCU UGGUGAUA | 6162 |
| 888 | CAUCAAGA G CAGCGUGG | 5886 | CCACCCUG GCCGAAAGGCGAGUGAGGUCU UCUUGAUG | 6163 |
| 891 | CAAGAGCA G CGUGCUGG | 5887 | CCACCACG GCCGAAAGGCGAGUGAGGUCU UGCUCUUG | 6164 |
| 893 | AGACCAGC G UGGUGCCC | 5888 | GCCCACCA GCCGAAAGGCGAGUGAGGUCU GCUGCUCU | 6165 |
| 896 | GCACCGUG G UGGGCAGU | 5889 | ACUGCCCA GCCGAAAGGCGAGUGAGGUCU CACGCUGC | 6166 |
| 900 | CGUGGUCG G CAGUGAGC | 5890 | GCUCACUG GCCGAAAGGCGAGUGAGGUCU CCACCACG | 6167 |
| 903 | GGUGGGCA G UCAGCGGA | 5891 | UCCGCUCA GCCGAAAGGCGAGUGAGGUCU UGCCCACC | 6168 |
| 907 | GGCAGUGA G CGGAAGCG | 5892 | CGCUUCCG GCCGAAAGGCGAGUGAGGUCU UCACUGCC | 6169 |
| 913 | GAGCGGAA G CGAGGAAU | 5893 | AUUCCUCG GCCGAAAGGCGAGUGAGGUCU UUCCGCUC | 6170 |
| 922 | CGAGGAAU G CAGCUGGA | 5894 | UCCAGCUG GCCGAAAGGCGAGUGAGGUCU AUUCCUCG | 6171 |
| 925 | GGAAUGCA G CUGGAAGA | 5895 | UCUUCCAG GCCGAAAGGCGAGUGAGGUCU UGCAUUCC | 6172 |
| 943 | CUCAAACA G CAGCUCCA | 5896 | UGGAGCUG GCCGAAAGGCGAGUGAGGUCU UGUUUGAC | 6173 |
| 946 | AAACAGCA G CUCCAGCA | 5897 | UGCUGGAC GCCGAAAGGCGAGUGAGGUCU UGCUGUUU | 6174 |
| 952 | CAGCUCCA G CAGCCCGA | 5898 | UCGGCCUG GCCGAAAGGCGAGUGAGGUCU UGGAGCUG | 6175 |
| 956 | UCCAGCAC G CCGAGGAG | 5899 | CUCCUCGG GCCGAAAGGCGAGUGAGGUCU CUGCUGGA | 6176 |
| 965 | CCGAGGAG G CCCUGGUG | 5900 | CACCAGGG GCCGAAAGGCGAGUGAGGUCU CUCCUCGG | 6177 |
| 971 | AGGCCCUG G UGGCCAAA | 5901 | UUUGGCCA GCCGAAAGGCGAGUGAGGUCU CAGGGCCU | 6178 |
| 974 | CCCUGGUG G CCAAACAG | 5902 | CUGUUUGG GCCGAAAGGCGAGUGAGGUCU CACCAGGG | 6179 |
| 986 | AACAGGAG G UGAUCGAU | 5903 | AUCGAUCA GCCGAAAGGCGAGUGAGGUCU CUCCUGUU | 6180 |
| 997 | AUCGAUAA G CUGAAGGA | 5904 | UCCUUCAG GCCGAAAGGCGAGUGAGGUCU UUAUCGAU | 6181 |

TABLE V-continued

Human IKK-gamma Zinzyme and Substrate Sequence

| Pos | Substrate | Seq ID | Zinzyme | Seq ID |
|---|---|---|---|---|
| 1010 | AGGAGGAG G CCGAGCAG | 5905 | CUGCUCGG GCCGAAAGGCGAGUGAGGUCU CUCCUCCU | 6182 |
| 1015 | GAGGCCGA G CAGCACAA | 5906 | UUGUGCUG GCCGAAAGGCGAGUGAGGUCU UCGGCCUC | 6183 |
| 1018 | GCCGAGCA G CACAAGAU | 5907 | AUCUUGUG GCCGAAAGGCGAGUGAGGUCU UGCUCGGC | 6184 |
| 1028 | ACAAGAUU G UGAUGGAG | 5908 | CUCCAUCA GCCGAAAGGCGAGUGAGGUCU AAUCUUGU | 6185 |
| 1040 | UGGAGACC G UUCCGGUG | 5909 | CACCGGAA GCCGAAAGGCGAGUGAGGUCU GGUCUCCA | 6186 |
| 1046 | CCGUUCCG G UGCUGAAG | 5910 | CUUCAGCA GCCGAAAGGCGAGUGAGGUCU CGGAACGG | 6187 |
| 1048 | GUUCCGGU G CUGAAGGC | 5911 | GCCUUCAG GCCGAAAGGCGAGUGAGGUCU ACCGGAAC | 6188 |
| 1055 | UGCUGAAG G CCCAGGCG | 5912 | CGCCUGGG GCCGAAAGGCGAGUGAGGUCU CUUCAGCA | 6189 |
| 1061 | AGGCCCAG G CGGAUAUC | 5913 | GAUAUCCG GCCGAAAGGCGAGUGAGGUCU CUGGGCCU | 6190 |
| 1076 | UCUACAAG G CGGACUUC | 5914 | GAAGUCCG GCCGAAAGGCGAGUGAGGUCU CUUGUAGA | 6191 |
| 1088 | ACUUCCAG G CUGAGAGG | 5915 | CCUCUCAG GCCGAAAGGCGAGUGAGGUCU CUGGAAGU | 6192 |
| 1096 | GCUGAGAG G CAGGCCCG | 5916 | CGGGCCUG GCCGAAAGGCGAGUGAGGUCU CUCUCAGC | 6193 |
| 1100 | AGAGGCAG G CCCGGGAG | 5917 | CUCCCGGG GCCGAAAGGCGAGUGAGGUCU CUGCCUCU | 6194 |
| 1111 | CGGGAGAA G CUGGCCGA | 5918 | UCGGCCAG GCCGAAAGGCGAGUGAGGUCU UUCUCCCG | 6195 |
| 1115 | AGAAGCUG G CCGAGAAG | 5919 | CUUCUCGG GCCGAAAGGCGAGUGAGGUCU CAGCUUCU | 6196 |
| 1129 | AAGAAGGA G CUCCUGCA | 5920 | UGCAGGAG GCCGAAAGGCGAGUGAGGUCU UCCUUCUU | 6197 |
| 1135 | GAGCUCCU G CAGGAGCA | 5921 | UGCUCCUG GCCGAAAGGCGAGUGAGGUCU AGGAGCUC | 6198 |
| 1141 | CUGCAGGA G CAGCUGGA | 5922 | UCCAGCUG GCCGAAAGGCGAGUGAGGUCU UCCUGCAG | 6199 |
| 1144 | CAGGACCA G CUGGAGCA | 5923 | UGCUCCAG GCCGAAAGGCGAGUGAGGUCU UGCUCCUG | 6200 |
| 1150 | CAGCUGGA G CAGCUGCA | 5924 | UGCAGCUG GCCGAAAGGCGAGUGAGGUCU UCCAGCUG | 6201 |
| 1153 | CUGGAGCA G CUGCAGAG | 5925 | CUCUGCAG GCCGAAAGGCGAGUGAGGUCU UGCUCCAG | 6202 |
| 1156 | GAGCAGCU G CAGAGGGA | 5926 | UCCCUCUG GCCGAAAGGCGAGUGAGGUCU AGCUGCUC | 6203 |
| 1165 | CAGAGGGA G UACAGCAA | 5927 | UUGCUGUA GCCGAAAGGCGAGUGAGGUCU UCCCUCUG | 6204 |
| 1170 | GGAGUACA G CAAACUGU | 5928 | UCAGUUUG GCCGAAAGGCGAGUGAGGUCU UGUACUCC | 6205 |
| 1181 | AACUGAAG G CCAGCUGU | 5929 | ACAGCUGG GCCGAAAGGCGAGUGAGGUCU CUUCAGUU | 6206 |
| 1185 | GAAGGCCA G CUGUCAGG | 5930 | CCUGACAG GCCGAAAGGCGAGUGAGGUCU UGGCCUUC | 6207 |
| 1188 | GGCCAGCU G UCAGGAGU | 5931 | ACUCCUGA GCCGAAAGGCGAGUGAGGUCU AGCUGGCC | 6208 |
| 1195 | UGUCAGGA G UCGGCCAG | 5932 | CUGGCCGA GCCGAAAGGCGAGUGAGGUCU UCCUGACA | 6209 |
| 1199 | AGGAGUCG G CCAGGAUC | 5933 | GAUCCUGG GCCGAAAGGCGAGUGAGGUCU CGACUCCU | 6210 |
| 1222 | AUGAGGAA G CGGCAUGU | 5934 | ACAUGCCG GCCGAAAGGCGAGUGAGGUCU UUCCUCAU | 6211 |
| 1225 | AGGAAGCG G CAUGUCGA | 5935 | UCGACAUG GCCGAAAGGCGAGUGAGGUCU CGCUUCCU | 6212 |
| 1229 | AGCGGCAU G UCGAGGUC | 5936 | GACCUCGA GCCGAAAGGCGAGUGAGGUCU AUGCCGCU | 6213 |
| 1235 | AUGUCGAG G UCUCCCAG | 5937 | CUGGGAGA GCCGAAAGGCGAGUGAGGUCU CUCGACAU | 6214 |
| 1244 | UCUCCCAG G CCCCCUUG | 5938 | CAAGGGGG GCCGAAAGGCGAGUGAGGUCU CUGGGAGA | 6215 |
| 1252 | GCCCCCUU G CCCCCCGC | 5939 | GCGGGGGG GCCGAAAGGCGAGUGAGGUCU AAGGGGGC | 6216 |
| 1259 | UGCCCCCC G CCCCUGCC | 5940 | GGCAGGGG GCCGAAAGGCGAGUGAGGUCU GGGGGGCA | 6217 |
| 1265 | CCGCCCCU G CCUACCUC | 5941 | GAGGUAGG GCCGAAAGGCGAGUGAGGUCU AGGGGCGG | 6218 |
| 1286 | CUCCCCUG G CCCUGCCC | 5942 | GGGCAGGG GCCGAAAGGCGAGUGAGGUCU CAGGGGAG | 6219 |
| 1291 | CUGGCCCU G CCCAGCCA | 5943 | UGGCUGGG GCCGAAAGGCGAGUGAGGUCU AGGGCCAG | 6220 |
| 1296 | CCUGCCCA G CCAGAGGA | 5944 | UCCUCUGG GCCGAAAGGCGAGUGAGGUCU UGGGCAGG | 6221 |
| 1308 | GAGGAGGA G CCCCCCCG | 5945 | CGGGGGGG GCCGAAAGGCGAGUGAGGUCU UCCUCCUC | 6222 |
| 1321 | CCCGAGGA G CCACCUGA | 5946 | UCAGGUGG GCCGAAAGGCGAGUGAGGUCU UCCUCGGG | 6223 |
| 1335 | UGACUUCU G CUGUCCCA | 5947 | UGGGACAG GCCGAAAGGCGAGUGAGGUCU AGAAGUCA | 6224 |
| 1338 | CUUCUGCU G UCCCAAGU | 5948 | ACUUGGGA GCCGAAAGGCGAGUGAGGUCU AGCAGAAG | 6225 |
| 1345 | UGUCCCAA G UGCCAGUA | 5949 | UACUGGCA GCCGAAAGGCGAGUGAGGUCU UUGGGACA | 6226 |
| 1347 | UCCCAAGU G CCAGUAUC | 5950 | GAUACUGG GCCGAAAGGCGAGUGAGGUCU ACUUGGGA | 6227 |
| 1351 | AAGUGCCA G UAUCAGGC | 5951 | GCCUGAUA GCCGAAAGGCGAGUGAGGUCU UGGCACUU | 6228 |
| 1358 | AGUAUCAG G CCCCUGAU | 5952 | AUCAGGGG GCCGAAAGGCGAGUGAGGUCU CUGAUACU | 6229 |
| 1378 | GACACCCU G CAGAUACA | 5953 | UGUAUCUG GCCGAAAGGCGAGUGAGGUCU AGGGUGUC | 6230 |
| 1388 | AGAUACAU G UCAUGGAG | 5954 | CUCCAUGA GCCGAAAGGCGAGUGAGGUCU AUGUAUCU | 6231 |
| 1396 | GUCAUGGA G UGCAUUGA | 5955 | UCAAUGCA GCCGAAAGGCGAGUGAGGUCU UCCAUGAC | 6232 |
| 1398 | CAUGGAGU G CAUUGAGU | 5956 | ACUCAAUG GCCGAAAGGCGAGUGAGGUCU ACUCCAUG | 6233 |
| 1405 | UGCAUUGA G UAGGGCCG | 5957 | CGGCCCUA GCCGAAAGGCGAGUGAGGUCU UCAAUGCA | 6234 |
| 1410 | UUGAGUAGG G CCGGCCAG | 5958 | CUGGCCGG GCCGAAAGGCGAGUGAGGUCU CCUACUCA | 6235 |
| 1414 | GUAGGGCCG G CCAGUGCA | 5959 | UGCACUGG GCCGAAAGGCGAGUGAGGUCU CGGCCCUA | 6236 |
| 1418 | GCCGGCCA G UGCAAGGC | 5960 | GCCUUGCA GCCGAAAGGCGAGUGAGGUCU UGGCCGGC | 6237 |
| 1420 | CGGCCAGU G CAAGGCCA | 5961 | UGGCCUUG GCCGAAAGGCGAGUGAGGUCU ACUGGCCG | 6238 |
| 1425 | AGUGCAAG G CCACUGCC | 5962 | GGCAGUGG GCCGAAAGGCGAGUGAGGUCU CUUGCACU | 6239 |
| 1431 | AGGCCACU G CCUGCCCG | 5963 | CGGGCAGG GCCGAAAGGCGAGUGAGGUCU AGUGGCCU | 6240 |
| 1435 | CACUGCCU G CCCGAGGA | 5964 | UCCUCGGG GCCGAAAGGCGAGUGAGGUCU AGGCAGUG | 6241 |
| 1445 | CCGAGGAC G UGCCCGGG | 5965 | CCCGGGCA GCCGAAAGGCGAGUGAGGUCU GUCCUCGG | 6242 |
| 1447 | GAGGACGU G CCCGGGAC | 5966 | GUCCCGGG GCCGAAAGGCGAGUGAGGUCU ACGUCCUC | 6243 |
| 1457 | CCGGGACC G UGCAGUCU | 5967 | AGACUGCA GCCGAAAGGCGAGUGAGGUCU GGUCCCGG | 6244 |
| 1459 | GGGACCGU G CAGUCGC | 5968 | GCAGACUG GCCGAAAGGCGAGUGAGGUCU ACGGUCCC | 6245 |
| 1462 | ACCGUGCA G UCUGCGCU | 5969 | AGCGCAGA GCCGAAAGGCGAGUGAGGUCU UGCACGGU | 6246 |
| 1466 | UGCAGUCU G CGCUUUCC | 5970 | GGAAAGCG GCCGAAAGGCGAGUGAGGUCU AGACUGCA | 6247 |
| 1468 | CAGUCUGC G CUUUCCUC | 5971 | GAGGAAAG GCCGAAAGGCGAGUGAGGUCU GCAGACUG | 6248 |
| 1481 | CCUCUCCC G CCUGCCUA | 5972 | UAGGCAGG GCCGAAAGGCGAGUGAGGUCU GGGAGAGG | 6249 |
| 1485 | UCCCGCCU G CCUAGCCC | 5973 | GGGCUAGG GCCGAAAGGCGAGUGAGGUCU AGGCGGGA | 6250 |
| 1490 | CCUGCCUA G CCCAGGAU | 5974 | AUCCUGGG GCCGAAAGGCGAGUGAGGUCU UAGGCAGG | 6251 |
| 1504 | GAUGAAGG G CUGGGUGG | 5975 | CCACCCAG GCCGAAAGGCGAGUGAGGUCU CCUUCAUC | 6252 |
| 1509 | AGGGCUGG G UGGCCACA | 5976 | UGUGCCCA GCCGAAAGGCGAGUGAGGUCU CCAGCCCU | 6253 |
| 1512 | GCUGGGUG G CCACAACU | 5977 | AGUUGUGG GCCGAAAGGCGAGUGAGGUCU CACCCAGC | 6254 |
| 1526 | ACUGGGAU G CCACCUGG | 5978 | CCAGGUGG GCCGAAAGGCGAGUGAGGUCU AUCCCAGU | 6255 |

TABLE V-continued

Human IKK-gamma Zinzyme and Substrate Sequence

| Pos | Substrate | Seq ID | Zinzyme | Seq ID |
|---|---|---|---|---|
| 1536 | CACCUGGA G CCCCACCC | 5979 | GGGUGGGG GCCGAAAGGCGAGUGAGGUCU UCCAGGUG | 6256 |
| 1549 | ACCCAGGA G CUGGCCGC | 5980 | GCGGCCAG GCCGAAAGGCGAGUGAGGUCU UCCUGGGU | 6257 |
| 1553 | AGGAGCUG G CCGCGGCA | 5981 | UGCCGCGG GCCGAAAGGCGAGUGAGGUCU CAGCUCCU | 6258 |
| 1556 | AGCUGGCC G CGGCACCU | 5982 | AGGUGCCG GCCGAAAGGCGAGUGAGGUCU GGCCAGCU | 6259 |
| 1559 | UGGCCGCG G CACCUUAC | 5983 | GUAAGGUG GCCGAAAGGCGAGUGAGGUCU CGCGGCCA | 6260 |
| 1568 | CACCUUAC G CUUCAGCU | 5984 | AGCUGAAG GCCGAAAGGCGAGUGAGGUCU GUAAGGUG | 6261 |
| 1574 | ACGCUUCA G CUGUUGAU | 5985 | AUCAACAG GCCGAAAGGCGAGUGAGGUCU UGAAGCGU | 6262 |
| 1577 | CUUCAGCU G UUGAUCCG | 5986 | CGGAUCAA GCCGAAAGGCGAGUGAGGUCU AGCUGAAG | 6263 |
| 1585 | GUUGAUCC G CUGGUCCC | 5987 | GGGACCAG GCCGAAAGGCGAGUGAGGUCU GGAUCAAC | 6264 |
| 1589 | AUCCGCUG G UCCCCUCU | 5988 | AGAGGGGA GCCGAAAGGCGAGUGAGGUCU CAGCGGAU | 6265 |
| 1604 | CUUUUGGG G UAGAUGCG | 5989 | CGCAUCUA GCCGAAAGGCGAGUGAGGUCU CCCAAAAG | 6266 |
| 1610 | GGGUAGAU G CGGCCCCG | 5990 | CGGGGCCG GCCGAAAGGCGAGUGAGGUCU AUCUACCC | 6267 |
| 1613 | UAGAUGCG G CCCCGAUC | 5991 | GAUCGGGG GCCGAAAGGCGAGUGAGGUCU CGCAUCUA | 6268 |
| 1624 | CCGAUCAG G CCUGACUC | 5992 | GAGUCAGG GCCGAAAGGCGAGUGAGGUCU CUGAUCGG | 6269 |
| 1633 | CCUGACUC G CUGCUCUU | 5993 | AAGAGCAG GCCGAAAGGCGAGUGAGGUCU GAGUCAGG | 6270 |
| 1636 | GACUCGCU G CUCUUUUU | 5994 | AAAAAGAG GCCGAAAGGCGAGUGAGGUCU AGCGAGUC | 6271 |
| 1645 | CUCUUUUU G UUCCCUUC | 5995 | GAAGGGAA GCCGAAAGGCGAGUGAGGUCU AAAAAGAG | 6272 |
| 1655 | UCCCUUCU G UCUGCUCG | 5996 | CGAGCAGA GCCGAAAGGCGAGUGAGGUCU AGAAGGGA | 6273 |
| 1659 | UUCUGUCU G CUCGAACC | 5997 | GGUUCGAG GCCGAAAGGCGAGUGAGGUCU AGACAGAA | 6274 |
| 1672 | AACCACUU G CCUCGGGC | 5998 | GCCCGAGG GCCGAAAGGCGAGUGAGGUCU AAGUGGUU | 6275 |
| 1679 | UGCCUCGG G CUAAUCCC | 5999 | GGGAUUAG GCCGAAAGGCGAGUGAGGUCU CCGAGGCA | 6276 |
| 1706 | UCCACCCG G CACUGGGG | 6000 | CCCCAGUG GCCGAAAGGCGAGUGAGGUCU CGGGUGGA | 6277 |
| 1717 | CUGGGGAA G UCAAOAAU | 6001 | AUUCUUGA GCCGAAAGGCGAGUGAGGUCU UUCCCCAG | 6278 |
| 1729 | AGAAUGGG G CCUGGGGC | 6002 | GCCCCAGG GCCGAAAGGCGAGUGAGGUCU CCCAUUCU | 6279 |
| 1736 | GGCCUGGG G CUCUCAGG | 6003 | CCUGAGAG GCCGAAAGGCGAGUGAGGUCU CCCAGGCC | 6280 |
| 1752 | GGAGAACU G CUUCCCCU | 6004 | AGGGGAAG GCCGAAAGGCGAGUGAGGUCU AGUUUCUC | 6281 |
| 1762 | UUCCCCUG G CAGAGCUG | 6005 | CAGCUCUG GCCGAAAGGCGAGUGAGGUCU CAGGGGAA | 6282 |
| 1767 | CUGGCAGA G CUGGGUGG | 6006 | CCACCCAG GCCGAAAGGCGAGUGAGGUCU UCUGCCAG | 6283 |
| 1772 | AGAGCUGG G UGGCAGCU | 6007 | AGCUGCCA GCCGAAAGGCGAGUGAGGUCU CCAGCUCU | 6284 |
| 1775 | GCUGGGUG G CAGCUCUU | 6008 | AAGAGCUG GCCGAAAGGCGAGUGAGGUCU CACCCAGC | 6285 |
| 1778 | GGGUGGCA G CUCUUCCU | 6009 | AGGAAGAG GCCGAAAGGCGAGUGAGGUCU UGCCACCC | 6286 |
| 1805 | ACCGACCC G CCCGCCGC | 6010 | GCGGCGGG GCCGAAAGGCGAGUGAGGUCU GGGUCGGU | 6287 |
| 1809 | ACCCGCCC G CCGCUGUG | 6011 | CACAGCGG GCCGAAAGGCGAGUGAGGUCU GGGCGGGU | 6288 |
| 1812 | CGCCCGCC G CUGUGCCC | 6012 | CGGCACAG GCCGAAAGGCGAGUGAGGUCU CGCGCGCG | 6289 |
| 1815 | CCGCCGCU G UGCCCUGG | 6013 | CCACGGCA GCCGAAAGGCGAGUGAGGUCU AGCGGCCG | 6290 |
| 1817 | GCCGCUGU G CCCUGGGA | 6014 | UCCCAGGG GCCGAAAGGCGAGUGAGGUCU ACAGCGGC | 6291 |
| 1826 | CCCUGGGA G UGCUGCCC | 6015 | GGGCAGCA GCCGAAAGGCGAGUGAGGUCU UCCCAGGC | 6292 |
| 1828 | CUGGGAGU G CUGCCCUC | 6016 | GAGCGCAG GCCGAAAGGCGAGUGAGGUCU ACUCCCAG | 6293 |
| 1831 | GGAGUGCU G CCCUCUUA | 6017 | UAACAGGG GCCGAAAGGCGAGUGAGGUCU AGCACUCC | 6294 |
| 1844 | CUUACCAU G CACACGGG | 6018 | CCCGUGUG GCCGAAAGGCGAGUGAGGUCU AUGGUAAG | 6295 |
| 1852 | GCACACGG G UGCUCUCC | 6019 | GGAGAGCA GCCGAAAGGCGAGUGAGGUCU CCGUGUGC | 6296 |
| 1854 | ACACGGGU G CUCUCCUU | 6020 | AAGCAGAG GCCGAAAGGCGAGUGAGGUCU ACCCGUGU | 6297 |
| 1867 | CCUUUUGG G CUGCAUGC | 6021 | GCAUGCAC GCCGAAAGGCGAGUGAGGUCU CCAAAACG | 6298 |
| 1870 | UUUGGGCU G CAUGCUAU | 6022 | AUAGCAUG GCCGAAAGGCGAGUGAGGUCU AGCCCAAA | 6299 |
| 1874 | GGCUGCAU G CUAUUCCA | 6023 | UGGAAUAG GCCGAAAGGCGAGUGAGGUCU AUGCAGCC | 6300 |
| 1887 | UCCAUUUU G CAGCCAGA | 6024 | UCUGGCUG GCCGAAAGGCGAGUGAGGUCU AAAAUGGA | 6301 |
| 1890 | AUUUUGCA G CCAGACCG | 6025 | CGGUCUGC GCCGAAAGGCGAGUGAGGUCU UGCAAAAU | 6302 |
| 1901 | AGACCGAU G UGUAUUUA | 6026 | UAAAUACA GCCGAAAGGCGAGUGAGGUCU AUCGGUCU | 6303 |
| 1903 | ACCGAUGU G UAUUUAAC | 6027 | GUUAAAUA GCCGAAAGGCGAGUGAGGUCU ACAUCGGU | 6304 |
| 1914 | UUUAACCA G UCACUAUU | 6028 | AAUAGUCA GCCGAAAGGCGAGUGAGGUCU UGGUUAAA | 6305 |
| 1936 | ACAUUUGG G UUGUUUCC | 6029 | GGAAACAA GCCGAAAGGCGAGUGAGGUCU CCAAAUGU | 6306 |
| 1939 | UUUGGGUU G UUUCCCAU | 6030 | AUGGGAAA GCCGAAAGGCGAGUGAGGUCU AACCCAAA | 6307 |
| 1954 | AUCUUUUU G UUACCAUA | 6031 | UAUGGUAA GCCGAAAGGCGAGUGAGGUCU AAAAAGAU | 6308 |
| 1970 | AAAUAAUG G CAUAGUAA | 6032 | UUACUAUG GCCGAAAGGCGAGUGAGGUCU CAUUAUUU | 6309 |
| 1975 | AUGCCAUA G UAAAAAAA | 6033 | UUUUUUUA GCCGAAAGGCGAGUGAGGUCU UAUGCCAU | 6310 |

Input Sequence = NM_003639. Cut Site = G/Y
Arm Length = 8. Core Sequence GCcgaaagGCGaGuCaaGGuCu
NM_003639 (*Homo sapiens* inhibitor of kappa light polypeptide gene enhancer in B-cells, kinase gamma (IKBKG), mRNA.; 1994 bp)

TABLE VI

Human IKK-gamma DNAzyme and Substrate Sequence

| Pos | Substrate | Seq ID | DNAzyme | Seq ID |
|---|---|---|---|---|
| 10 | GCACGAGC A UGGCCCUU | 4749 | AAGGGCCA GGCTAGCTACAACGA GCTCGTGC | 6380 |
| 13 | CGAGCAUG G CCUUGUG | 5757 | CACAAGGG GGCTAGCTACAACGA CATGCTCG | 6381 |
| 19 | UGGCCCUU G UGAUCCAG | 5758 | CTGGATCA GGCTAGCTACAACGA AAGGGCCA | 6382 |
| 22 | CCCUUGUG A UCCAGGUG | 6311 | CACCTGGA GGCTAGCTACAACGA CACAAGGG | 6383 |

TABLE VI-continued

Human IKK-gamma DNAzyme and Substrate Sequence

| Pos | Substrate | Seq ID | DNAzyme | Seq ID |
|---|---|---|---|---|
| 28 | UGAUCCAG G UGGGGAAA | 5759 | TTTCCCCA GGCTAGCTACAACGA CTGGATCA | 6384 |
| 36 | GUGGGGAA A CUAAGGCC | 6312 | GGCCTTAG GGCTAGCTACAACGA TTCCCCAC | 6385 |
| 42 | AAACUAAG G CCCAGAGA | 5760 | TCTCTGGG GGCTAGCTACAACGA CTTAGTTT | 6386 |
| 52 | CCAGAGAA G UGAGGACC | 5761 | GGTCCTCA GGCTAGCTACAACGA TTCTCTGG | 6387 |
| 58 | AAGUGAGG A CCCCGCAG | 6313 | CTGCGGGG GGCTAGCTACAACGA CCTCACTT | 6388 |
| 63 | AGGACCCC G CAGACUAU | 5762 | ATAGTCTG GGCTAGCTACAACGA GGGGTCCT | 6389 |
| 67 | CCCCGCAG A CUAUCAAU | 6314 | ATTGATAG GGCTAGCTACAACGA CTGCGGGG | 6390 |
| 70 | CGCAGACU A UCAAUCCC | 4364 | GGGATTGA GGCTAGCTACAACGA AGTCTGCG | 6391 |
| 74 | GACUAUCA A UCCCAGUC | 6315 | GACTGGGA GGCTAGCTACAACGA TGATAGTC | 6392 |
| 80 | CAAUCCCA G UCUCUUCC | 5763 | GGAAGAGA GGCTAGCTACAACGA TGGGATTG | 6393 |
| 93 | UUCCCCUC A CUCCCUGU | 4774 | ACAGGGAG GGCTAGCTACAACGA GAGGGGAA | 6394 |
| 100 | CACUCCCU G UGAAGCUC | 5764 | GAGCTTCA GGCTAGCTACAACGA AGGGAGTG | 6395 |
| 105 | CCUGUGAA G CUCUCCAG | 5765 | CTGGAGAG GGCTAGCTACAACGA TTCACAGG | 6396 |
| 113 | GCUCUCCA G CAUCAUCG | 5766 | CGATGATG GGCTAGCTACAACGA TGGAGAGC | 6397 |
| 115 | UCUCCAGC A UCAUCGGA | 4783 | CTCGATGA GGCTAGCTACAACGA GCTGGAGA | 6398 |
| 118 | CCAGCAUC A UCGAGGUC | 4784 | GACCTCGA GGCTAGCTACAACGA GATGCTGG | 6399 |
| 124 | UCAUCGAG G UCCCAUCA | 5767 | TGATGGGA GGCTAGCTACAACGA CTCGATGA | 6400 |
| 129 | GAGGUCCC A UCAGCCCU | 4787 | AGGGCTGA GGCTAGCTACAACGA GGGACCTC | 6401 |
| 133 | UCCCAUCA G CCCUUGCC | 5768 | GGCAAGGG GGCTAGCTACAACGA TGATGGGA | 6402 |
| 139 | CAGCCCUU G CCCUGUUG | 5769 | CAACAGGG GGCTAGCTACAACGA AAGGGCTG | 6403 |
| 144 | CUUGCCCU G UUGGAUGA | 5770 | TCATCCAA GGCTAGCTACAACGA AGGGCAAG | 6404 |
| 149 | CCUGUUGG A UGAAUAGG | 6316 | CCTATTCA GGCTAGCTACAACGA CCAACAGG | 6405 |
| 153 | UUGGAUGA A UAGGCACC | 6317 | GGTGCCTA GGCTAGCTACAACGA TCATCCAA | 6406 |
| 157 | AUGAAUAG G CACCCUG | 5771 | CAGAGGTG GGCTAGCTACAACGA CTATTCAT | 6407 |
| 159 | GAAUAGGC A CCCUCUGGA | 4795 | TCCAGAGG GGCTAGCTACAACGA GCCTATTC | 6408 |
| 171 | CUGGAAGA G CCAACUGU | 5772 | ACAGTTGG GGCTAGCTACAACGA TCTTCCAG | 6409 |
| 175 | AAGAGCCA A CUGUGUGA | 6318 | TCACACAG GGCTAGCTACAACGA TGGCTCTT | 6410 |
| 178 | AGCCAACU G UGUGAGAU | 5773 | ATCTCACA GGCTAGCTACAACGA AGTTGGCT | 6411 |
| 180 | CCAACUGU G UGAGAUGG | 5774 | CCATCTCA GGCTAGCTACAACGA ACAGTTGG | 6412 |
| 185 | UGUGUGAG A UGGUCCAG | 6319 | CTGCACCA GGCTAGCTACAACGA CTCACACA | 6413 |
| 188 | GUGAGAUG G UGCAGCCC | 5775 | GGGCTGCA GGCTAGCTACAACGA CATCTCAC | 6414 |
| 190 | GAGAUGGU G CAGCCCAG | 5776 | CTGGGCTG GGCTAGCTACAACGA ACCATCTC | 6415 |
| 193 | AUGGUGCA G CCCAGUGG | 5777 | CCACTGGG GGCTAGCTACAACGA TGCACCAT | 6416 |
| 198 | GCAGCCCA G UGGUGGCC | 5778 | GGCCACCA GGCTAGCTACAACGA TGGGCTGC | 6417 |
| 201 | GCCCAGUG G UGGCCCGG | 5779 | CCGGGCCA GGCTAGCTACAACGA CACTGGGC | 6418 |
| 204 | CAGUGGUG G CCCGGCAG | 5780 | CTGCCGGG GGCTAGCTACAACGA CACCACTG | 6419 |
| 209 | GUGGCCCG G CAGCAGAU | 5781 | ATCTGCTG GGCTAGCTACAACGA CGGGCCAC | 6420 |
| 212 | GCCCGGCA G CAGAUCAG | 5782 | CTGATCTG GGCTAGCTACAACGA TGCCGGGC | 6421 |
| 216 | GGCAGCAG A UCAGGACG | 6320 | CGTCCTGA GGCTAGCTACAACGA CTGCTGCC | 6422 |
| 222 | AGAUCAGG A CGUACGG | 6321 | CCAGTACG GGCTAGCTACAACGA CCTGATCT | 6423 |
| 224 | AUCAGGAC G UACUGGGC | 5783 | GCCCAGTA GGCTAGCTACAACGA GTCCTGAT | 6424 |
| 226 | CAGGACGU A CUGGGCGA | 4384 | TCGCCCAG GGCTAGCTACAACGA ACGTCCTG | 6425 |
| 231 | CGUACUGG G CGAAGAGU | 5784 | ACTCTTCG GGCTAGCTACAACGA CCAGTACG | 6426 |
| 238 | GGCGAAGA G UCUCCUCU | 5785 | AGAGGAGA GGCTAGCTACAACGA TCTTCGCC | 6427 |
| 253 | CUGGGGAA G CCAGCCAU | 5786 | ATGGCTGG GGCTAGCTACAACGA TTCCCCAG | 6428 |
| 257 | GGAAGCCA G CCAUGCUG | 5787 | CAGCATGG GGCTAGCTACAACGA TGGCTTCC | 6429 |
| 260 | AGCCAGCC A UGCUGCAC | 4819 | GTGCAGCA GGCTAGCTACAACGA GGCTGGCT | 6430 |
| 262 | CCAGCCAU G CUGCACCU | 5788 | AGGTGCAG GGCTAGCTACAACGA ATGCTGG | 6431 |
| 265 | GCCAUGCU G CACCUGCC | 5789 | GGCAGGTG GGCTAGCTACAACGA AGCATGGC | 6432 |
| 267 | CAUGCUGC A CCUGCCUU | 4821 | AAGGCAGG GGCTAGCTACAACGA GCAGCATG | 6433 |
| 271 | CUGCACCU G CCUUCAGA | 5790 | TCTGAAGG GGCTAGCTACAACGA AGGTGCAG | 6434 |
| 280 | CCUUCAGA A CAGGGCGC | 6322 | GCGCCCTG GGCTAGCTACAACGA TCTGAAGG | 6435 |
| 285 | AGAACAGG G CGCUCCUG | 5791 | CAGGAGCG GGCTAGCTACAACGA CCTGTTCT | 6436 |
| 287 | AACACGGC G CUCCUGAG | 5792 | CTCAGGAG GGCTAGCTACAACGA GCCCTGTT | 6437 |
| 296 | CUCCUGAG A CCCUCCAG | 6323 | CTGGAGGG GGCTAGCTACAACGA CTCAGGAG | 6438 |
| 304 | ACCCUCCA G CGCUGCCU | 5793 | AGGCAGCG GGCTAGCTACAACGA TGGAGGGT | 6439 |
| 306 | CCUCCAGC G CUGCCUGG | 5794 | CCAGGCAG GGCTAGCTACAACGA GCTGGAGG | 6440 |
| 309 | CCAGCGCU G CCUGGAGG | 5795 | CCTCCAGG GGCTAGCTACAACGA AGCGCTGG | 6441 |
| 321 | GGAGGAGA A UCAAGAGC | 6324 | GCTCTTGA GGCTAGCTACAACGA TCTCCTCC | 6442 |
| 328 | AAUCAAGA G CUCCGAGA | 5796 | TCTCGGAG GGCTAGCTACAACGA TCTTGATT | 6443 |
| 336 | GCUCCGAG A UGCCAUCC | 6325 | GGATGGCA GGCTAGCTACAACGA CTCGGAGC | 6444 |
| 338 | UCCGAGAU G CCAUCCGG | 5797 | CCGGATGG GGCTAGCTACAACGA ATCTCGGA | 6445 |
| 341 | GAGAUGCC A UCCGGCAG | 4843 | CTGCCGGA GGCTAGCTACAACGA GGCATCTC | 6446 |
| 346 | GCCAUCCG G CAGAGCAA | 5798 | TTGCTCTG GGCTAGCTACAACGA CGGATGGC | 6447 |
| 351 | CCGGCAGA G CAACCAGA | 5799 | TCTGGTTG GGCTAGCTACAACGA TCTGCCGG | 6448 |
| 354 | GCAGAGCA A CCAGAUUC | 6326 | GAATCTGG GGCTAGCTACAACGA TGCTCTGC | 6449 |
| 359 | GCAACCAG A UUCUGCGG | 6327 | CCGCAGAA GGCTAGCTACAACGA CTGGTTGC | 6450 |
| 364 | CAGAUUCU G CGGGAGCG | 5800 | CGCTCCCG GGCTAGCTACAACGA AGAATCTG | 6451 |
| 370 | CUGCGGGA G CGCUGCGA | 5801 | TCGCAGCG GGCTAGCTACAACGA TCCCGCAG | 6452 |
| 372 | GCGGGAGC G CUGCGAGG | 5802 | CCTCGCAC GGCTAGCTACAACGA GCTCCCGC | 6453 |
| 375 | GGAGCGCU G CGAGGAGC | 5803 | GCTCCTCG GGCTAGCTACAACGA AGCGCTCC | 6454 |
| 382 | UGCGAGGA G CUUCUGCA | 5804 | TGCAGAAG GGCTAGCTACAACGA TCCTCGCA | 6455 |
| 388 | GAGCUUCU G CAUUUCCA | 5805 | TGGAAATG GGCTAGCTACAACGA AGAAGCTC | 6456 |
| 390 | GCUUCUGC A UUUCCAAG | 4853 | CTTGGAAA GGCTAGCTACAACGA GCAGAAGC | 6457 |

TABLE VI-continued

Human IKK-gamma DNAzyme and Substrate Sequence

| Pos | Substrate | Seq ID | DNAzyme | Seq ID |
|-----|-----------|--------|---------|--------|
| 398 | AUUUCCAA G CCAGCCAG | 5806 | CTGGCTGG GGCTAGCTACAACGA TTGGAAAT | 6458 |
| 402 | CCAAGCCA G CCAGAGGG | 5807 | CCCTCTGG GGCTAGCTACAACGA TGGCTTGG | 6459 |
| 421 | GAGAAGGA G UUCCUCAU | 5808 | ATGAGGAA GGCTAGCTACAACGA TCCTTCTC | 6460 |
| 428 | AGUUCCUC A UGUGCAAC | 4862 | CTTGCACA GGCTAGCTACAACGA GAGGAACT | 6461 |
| 430 | UUCCUCAU G UGCAAGUU | 5809 | AACTTGCA GGCTAGCTACAACGA ATGAGCAA | 6462 |
| 432 | CCUCAUGU G CAAGUUCC | 5810 | CGAACTTG GGCTAGCTACAACGA ACATGAGG | 6463 |
| 436 | AUGUGCAA G UUCCAGGA | 5811 | TCCTGGAA GGCTAGCTACAACGA TTGCACAT | 6464 |
| 446 | UCCAGGAG G CCAGCAAA | 5812 | TTTCCTGG GGCTAGCTACAACGA CTCCTGGA | 6465 |
| 454 | GCCAGGAA A CUGGUGGA | 6328 | TCCACCAG GGCTAGCTACAACGA TTCCTGGC | 6466 |
| 458 | GGAAACUG G UGGAGAGA | 5813 | TCTCTCCA GGCTAGCTACAACGA CAGTTTCC | 6467 |
| 466 | GUGGAGAG A CUCGCCCU | 6329 | AGGGCGAG GGCTAGCTACAACGA CTCTCCAC | 6468 |
| 471 | GAGACUCG G CCUGGAGA | 5814 | TCTCCAGG GGCTAGCTACAACGA CGACTCTC | 6469 |
| 481 | CUGGAGAA G CUCGAUCU | 5815 | AGATCGAC GGCTAGCTACAACGA TTCTCCAG | 6470 |
| 486 | GAACCUCG A UCUGAAGA | 6330 | TCTTCAGA GGCTAGCTACAACGA CCAGCTTC | 6471 |
| 496 | CUGAAGAG G CAGAAGGA | 5816 | TCCTTCTG GGCTAGCTACAACGA CTCTTCAG | 6472 |
| 505 | CAGAAGCA G CACGCUCU | 5817 | AGAGCCTG GGCTAGCTACAACGA TCCTTCTG | 6473 |
| 509 | AGGAGCAG G CUCUCCGG | 5818 | CCCCAGAC GGCTAGCTACAACGA CTGCTCCT | 6474 |
| 514 | CAGCCUCU C GCGAGCU | 5819 | ACCTCCCG GGCTAGCTACAACGA AGAGCCTG | 6475 |
| 521 | UGCGGGAG G UGGAGCAC | 5820 | GTGCTCCA GGCTAGCTACAACGA CTCCCGCA | 6476 |
| 526 | GAGGUGGA G CACCUGAA | 5821 | TTCAGGTG GGCTAGCTACAACGA TCCACCTC | 6477 |
| 528 | GGUGGAGC A CCUGAAGA | 4878 | TCTTCAGG GGCTAGCTACAACGA GCTCCACC | 6478 |
| 538 | CUGAAGAG A UGCCAGCA | 6331 | TGCTGGCA GGCTAGCTACAACGA CTCTTCAG | 6479 |
| 540 | GAAGAGAU G CCAGCAGC | 5822 | GCTGCTGG GGCTAGCTACAACGA ATCTCTTC | 6480 |
| 544 | AGAUGCCA G CAGCAGAU | 5823 | ATCTGCTG GGCTAGCTACAACGA TGGCATCT | 6481 |
| 547 | UGCCAGCA G CAGAUGGC | 5824 | GCCATCTG GGCTAGCTACAACGA TGCTGGCA | 6482 |
| 551 | AGCAGCAG A UGGCUGAG | 6332 | CTCAGCCA GGCTAGCTACAACGA CTGCTGCT | 6483 |
| 554 | AGCAGAUG G CUGAGGAC | 5825 | GTCCTCAG GGCTAGCTACAACGA CATCTGCT | 6484 |
| 561 | GCUGAGG A CAAGGCCU | 6333 | AGGCCTTG GGCTAGCTACAACGA CCTCAGCC | 6485 |
| 566 | AGGACAAG G CCUCUGUG | 5826 | CACAGAGG GGCTAGCTACAACGA CTTGTCCT | 6486 |
| 572 | AGGCCUCU G UGAAAGCC | 5827 | GGCTTTCA GGCTAGCTACAACGA AGAGGCCT | 6487 |
| 578 | CUGUGAAA G CCCAGGUG | 5828 | CACCTGGG GGCTAGCTACAACGA TTTCACAG | 6488 |
| 584 | AAGCCCAG G UGACGUCC | 5829 | GGACGTCA GGCTAGCTACAACGA CTGGGCTT | 6489 |
| 587 | CCCAGGUG A CGUCCUUG | 6334 | CAAGGACG GGCTAGCTACAACGA CACCTGGG | 6490 |
| 589 | CAGGUGAC G UCCUUGCU | 5830 | AGCAAGGA GGCTAGCTACAACGA GTCACCTG | 6491 |
| 595 | ACGUCCUU G CUCGGGGA | 5831 | TCCCCGAG GGCTAGCTACAACGA AAGGACGT | 6492 |
| 604 | CUCGGGGA G CUGCAGGA | 5832 | TCCTGCAG GGCTAGCTACAACGA TCCCCGAG | 6493 |
| 607 | GGGGAGCU G CAGGAGAG | 5833 | CTCTCCTG GGCTAGCTACAACGA AGCTCCCC | 6494 |
| 615 | GCAGGAGA G CCAGAGUC | 5834 | GACTCTGG GGCTAGCTACAACGA TCTCCTGC | 6495 |
| 621 | GAGCCAGA G UCGCUUGG | 5835 | CCAAGCGA GGCTAGCTACAACGA TCTGGCTC | 6496 |
| 624 | CCAGAGUC G CUUGGAGG | 5836 | CCTCCAAG GGCTAGCTACAACGA GACTCTGG | 6497 |
| 632 | GCUUGGAG G CUGCCACU | 5837 | AGTGGCAG GGCTAGCTACAACGA CTCCAAGC | 6498 |
| 635 | UGGAGGCU G CCACUAAG | 5838 | CTTAGTGG GGCTAGCTACAACGA AGCCTCCA | 6499 |
| 638 | AGGCUGCC A CUAAGGAA | 4903 | TTCCTTAG GGCTAGCTACAACGA GGCAGCCT | 6500 |
| 646 | ACUAAGGA A UGCCAGGC | 6335 | GCCTGGCA GGCTAGCTACAACGA TCCTTAGT | 6501 |
| 648 | UAAGGAAU G CCAGGCUC | 5839 | GAGCCTGG GGCTAGCTACAACGA ATTCCTTA | 6502 |
| 653 | AAUGCCAG G CUCUGGAG | 5840 | CTCCAGAG GGCTAGCTACAACGA CTGGCATT | 6503 |
| 663 | UCUGGAGG G UCGGGCCC | 5841 | GGGCCCGA GGCTAGCTACAACGA CCTCCAGA | 6504 |
| 668 | AGGGUCGG G CCCGGGCG | 5842 | CGCCCGGG GGCTAGCTACAACGA CCGACCCT | 6505 |
| 674 | GGGCCCGG G CGGCCAGC | 5843 | GCTGGCCG GGCTAGCTACAACGA CCGGGCCC | 6506 |
| 677 | CCCGGGCG G CCAGCGAG | 5844 | CTCGCTGG GGCTAGCTACAACGA CGCCCGGG | 6507 |
| 681 | GGCGGCCA G CGAGCAGG | 5845 | CCTGCTCG GGCTAGCTACAACGA TGGCCGCC | 6508 |
| 685 | GCCAGCGA G CAGGCGCG | 5846 | CGCGCCTG GGCTAGCTACAACGA TCGCTGGC | 6509 |
| 689 | GCGAGCAG G CGCGGCAG | 5847 | CTGCCGCG GGCTAGCTACAACGA CTGCTCGC | 6510 |
| 691 | GAGCAGGC G CGGCAGCU | 5848 | AGCTGCCG GGCTAGCTACAACGA GCCTGCTC | 6511 |
| 694 | CAGGCGCG G CAGCUGGA | 5849 | TCCAGCTG GGCTAGCTACAACGA CGCGCCTG | 6512 |
| 697 | GCGCGGCA G CUGGAGAG | 5850 | CTCTCCAG GGCTAGCTACAACGA TGCCGCGC | 6513 |
| 705 | GCUGGAGA G UGAGCGGC | 5851 | CGCGCTCA GGCTAGCTACAACGA TCTCCAGC | 6514 |
| 709 | GAGAGUGA G CGCGAGGC | 5852 | GCCTCGCG GGCTAGCTACAACGA TCACTCTC | 6515 |
| 711 | GAGUGAGC G CGAGCCGC | 5853 | GCGCCTCG GGCTAGCTACAACGA GCTCACTC | 6516 |
| 716 | AGCGCGAG G CGCUGCAG | 5854 | CTGCAGCG GGCTAGCTACAACGA CTCGCGCT | 6517 |
| 718 | CGCGAGGC G CUGCAGCA | 5855 | TGCTGCAG GGCTAGCTACAACGA GCCTCGCG | 6518 |
| 721 | GAGGCGCU G CAGCAGCA | 5856 | TGCTGCTG GGCTAGCTACAACGA AGCGCCTC | 6519 |
| 724 | GCGCUGCA G CAGCAGCA | 5857 | TGCTGCTG GGCTAGCTACAACGA TGCAGCGC | 6520 |
| 727 | CUGCAGCA G CAGCACAG | 5858 | CTGTGCTG GGCTAGCTACAACGA TGCTGCAG | 6521 |
| 730 | CAGCAGCA G CACAGCGU | 5859 | ACGCTGTG GGCTAGCTACAACGA TGCTGCTG | 6522 |
| 732 | GCAGCAGC A CAGCGUGC | 4920 | GCACGCTG GGCTAGCTACAACGA GCTGCTGC | 6523 |
| 735 | GCAGCACA G CGUGCAGG | 5860 | CCTGCACG GGCTAGCTACAACGA TGTGCTGC | 6524 |
| 737 | AGCACAGC G UGCAGGUG | 5861 | CACCTGCA GGCTAGCTACAACGA GCTGTGCT | 6525 |
| 739 | CACAGCGU G CAGGUGGA | 5862 | TCCACCTG GGCTAGCTACAACGA ACGCTGTG | 6526 |
| 743 | GCGUGCAG G UGGACCAG | 5863 | CTGGTCCA GGCTAGCTACAACGA CTGCACGC | 6527 |
| 747 | GCAGGUGG A CCAGCUGC | 6336 | GCAGCTGG GGCTAGCTACAACGA CCACCTGC | 6528 |
| 751 | GUGGACCA G CUGCGCAU | 5864 | ATGCGCAG GGCTAGCTACAACGA TGGTCCAC | 6529 |
| 754 | GACCAGCU G CGCAUGCA | 5865 | TGCATGCG GGCTAGCTACAACGA AGCTGGTC | 6530 |
| 756 | CCAGCUGC G CAUGCAGG | 5866 | CCTGCATG GGCTAGCTACAACGA GCAGCTGG | 6531 |

TABLE VI-continued

Human IKK-gamma DNAzyme and Substrate Sequence

| Pos | Substrate | Seq ID | DNAzyme | Seq ID |
|---|---|---|---|---|
| 758 | AGCUGCGC A UGCAGGGC | 4926 | GCCCTGCA GGCTAGCTACAACGA GCGCAGCT | 6532 |
| 760 | CUGCGCAU G CAGGGCCA | 5867 | TGGCCCTG GGCTAGCTACAACGA ATGCGCAG | 6533 |
| 765 | CAUGCAGG G CCAGAGCG | 5868 | CGCTCTGG GGCTAGCTACAACGA CCTGCATG | 6534 |
| 771 | GGGCCAGA G CGUGGAGG | 5869 | CCTCCACG GGCTAGCTACAACGA TCTGGCCC | 6535 |
| 773 | GCCAGAGC G UGGAGGCC | 5870 | GGCCTCCA GGCTAGCTACAACGA GCTCTGGC | 6536 |
| 779 | GCGUGGAG G CCGCGCUC | 5871 | GAGCGCGG GGCTAGCTACAACGA CTCCACGC | 6537 |
| 782 | UGGAGGCC G CGCUCCGC | 5872 | GCGGAGCG GGCTAGCTACAACGA GGCCTCCA | 6538 |
| 784 | GAGGCCGC G CUCCGCAU | 5873 | ATGCGGAG GGCTAGCTACAACGA GCGGCCTC | 6539 |
| 789 | CGCGCUCC G CAUGGAGC | 5874 | GCTCCATG GGCTAGCTACAACGA GGAGCGCG | 6540 |
| 791 | CGCUCCGC A UGGAGCGC | 4933 | GCGCTCCA GGCTAGCTACAACGA GCGGAGCG | 6541 |
| 796 | CGCAUGGA G CGCCAGGC | 5875 | GCCTGGCG GGCTAGCTACAACGA TCCATGCG | 6542 |
| 798 | CAUGGAGC G CCAGGCCG | 5876 | CGGCCTGG GGCTAGCTACAACGA GCTCCATG | 6543 |
| 803 | AGCGCCAG G CCGCCUCG | 5877 | CGAGGCGG GGCTAGCTACAACGA CTGGCGCT | 6544 |
| 806 | GCCAGGCC G CCUCGGAG | 5878 | CTCCGAGG GGCTAGCTACAACGA GGCCTGGC | 6545 |
| 826 | AAGAGGAA G CUGGCCCA | 5879 | TGGGCCAG GGCTAGCTACAACGA TTCCTCTT | 6546 |
| 830 | GGAAGCUG G CCCAGUUG | 5880 | CAACTGGG GGCTAGCTACAACGA CAGCTTCC | 6547 |
| 835 | CUGGCCCA G UUGCAGGU | 5881 | ACCTGCAA GGCTAGCTACAACGA TGGGCCAG | 6548 |
| 838 | GCCCAGUU G CAGGUGGC | 5882 | GCCACCTG GGCTAGCTACAACGA AACTGGGC | 6549 |
| 842 | AGUUGCAG G UGGCCUAU | 5883 | ATAGGCCA GGCTAGCTACAACGA CTGCAACT | 6550 |
| 845 | UGCAGGUG G CCUAUCAC | 5884 | GTGATAGG GGCTAGCTACAACGA CACCTGCA | 6551 |
| 849 | GGUGGCCU A UCACCAGC | 4423 | GCTGGTGA GGCTAGCTACAACGA AGGCCACC | 6552 |
| 852 | GGCCUAUC A CCAGCUCU | 4946 | AGAGCTGG GGCTAGCTACAACGA GATAGGCC | 6553 |
| 856 | UAUCACCA G CUCUUCCA | 5885 | TGGAAGAG GGCTAGCTACAACGA TGGTGATA | 6554 |
| 868 | UUCCAAGA A UACGACAA | 6337 | TTGTCGTA GGCTAGCTACAACGA TCTTGGAA | 6555 |
| 870 | CCAAGAAU A CGACAACC | 4428 | GGTTGTCG GGCTAGCTACAACGA ATTCTTGG | 6556 |
| 873 | AGAAUACG A CAACCACA | 6338 | TGTGGTTG GGCTAGCTACAACGA CGTATTCT | 6557 |
| 876 | AUACGACA A CCACAUCA | 6339 | TGATGTGG GGCTAGCTACAACGA TGTCGTAT | 6558 |
| 879 | CGACAACC A CAUCAAGA | 4955 | TCTTGATG GGCTAGCTACAACGA GGTTGTCG | 6559 |
| 881 | ACAACCAC A UCAAGAGC | 4956 | GCTCTTGA GGCTAGCTACAACGA GTGGTTGT | 6560 |
| 888 | CAUCAAGA G CAGCGUGG | 5886 | CCACGCTG GGCTAGCTACAACGA TCTTGATG | 6561 |
| 891 | CAAGAGCA G CGUGGUGG | 5887 | CCACCACG GGCTAGCTACAACGA TGCTCTTG | 6562 |
| 893 | AGAGCAGC G UGGUGGCC | 5888 | GCCCACCA GGCTAGCTACAACGA GCTGCTCT | 6563 |
| 896 | GCAGCGUG G UGGGCAGU | 5889 | ACTGCCCA GGCTAGCTACAACGA CACGCTGC | 6564 |
| 900 | CGUGGUGG G CAGUGAGC | 5890 | GCTCACTG GGCTAGCTACAACGA CCACCACG | 6565 |
| 903 | GGUGGGCA G UGAGCGGA | 5891 | TCCGCTCA GGCTAGCTACAACGA TGCCCACC | 6566 |
| 907 | GGCAGUGA G CGGAAGCG | 5892 | CGCTTCCG GGCTAGCTACAACGA TCACTGCC | 6567 |
| 913 | GAGCGGAA G CGAGGAAU | 5893 | ATTCCTCG GGCTAGCTACAACGA TTCCGCTC | 6568 |
| 920 | AGCGAGGA A UGCAGCUG | 6340 | CAGCTGCA GGCTAGCTACAACGA TCCTCGCT | 6569 |
| 922 | CGAGGAAU G CACCUGGA | 5894 | TCCAGGTG GGCTAGCTACAACGA ATTCCTCG | 6570 |
| 925 | GGAAUGCA G CUGGAAGA | 5895 | TCTTCCAG GGCTAGCTACAACGA TGCATTCC | 6571 |
| 933 | GCUGGAAG A UCUCAAAC | 6341 | GTTTGAGA GGCTAGCTACAACGA CTTCCAGC | 6572 |
| 940 | GAUCUCAA A CAGCAGCU | 6342 | AGCTGCTG GGCTAGCTACAACGA TTGAGATC | 6573 |
| 943 | CUCAAACA G CAGCUCCA | 5896 | TGGAGCTG GGCTAGCTACAACGA TGTTTGAG | 6574 |
| 946 | AAACAGCA G CUCCAGCA | 5897 | TGCTGGAG GGCTAGCTACAACGA TGCTGTTT | 6575 |
| 952 | CAGCUCCA G CAGGCCGA | 5898 | TCGGCCTG GGCTAGCTACAACGA TGGAGCTG | 6576 |
| 956 | UCCAGCAG G CCGAGGAG | 5899 | CTCCTCGG GGCTAGCTACAACGA CTGCTGGA | 6577 |
| 965 | CCGAGGAG G CCCUGGUG | 5900 | CACCAGGG GGCTAGCTACAACGA CTCCTCGG | 6578 |
| 971 | AGGCCCUG G UGGCCAAA | 5901 | TTTGGCCA GGCTAGCTACAACGA CAGGGCCT | 6579 |
| 974 | CCCUGGUG G CCAAACAG | 5902 | CTGTTTGG GGCTAGCTACAACGA CACCAGGG | 6580 |
| 979 | GUGGCCAA A CAGGAGGU | 6343 | ACCTCCTG GGCTAGCTACAACGA TTGGCCAC | 6581 |
| 986 | AACAGGAG G UGAUCGAU | 5903 | ATCGATCA GGCTAGCTACAACGA CTCCTGTT | 6582 |
| 989 | AGGAGGUG A UCGAUAAG | 6344 | CTTATCGA GGCTAGCTACAACGA CACCTCCT | 6583 |
| 993 | GGUGAUCG A UAAGCUGA | 6345 | TCAGCTTA GGCTAGCTACAACGA CGATCACC | 6584 |
| 997 | AUCGAUAA G CUGAAGGA | 5904 | TCCTTCAG GGCTAGCTACAACGA TTATCGAT | 6585 |
| 1010 | AGGAGGAG G CCGAGCAG | 5905 | CTGCTCGG GGCTAGCTACAACGA CTCCTCCT | 6586 |
| 1015 | GAGGCCGA G CAGCACAA | 5906 | TTGTGCTG GGCTAGCTACAACGA TCGGCCTC | 6587 |
| 1018 | GCCGAGCA G CACAAGAU | 5907 | ATCTTGTG GGCTAGCTACAACGA TGCTGGGC | 6588 |
| 1020 | CGAGCAGC A CAAGAUUG | 4980 | CAATCTTG GGCTAGCTACAACGA GCTGCTCG | 6589 |
| 1025 | AGCACAAG A UUGUGAUG | 6346 | CATCACAA GGCTAGCTACAACGA CTTGTGCT | 6590 |
| 1028 | ACAAGAUU G UGAUGGAG | 5908 | CTCCATCA GGCTAGCTACAACGA AATCTTGT | 6591 |
| 1031 | AGAUUGUG A UGGAGACA | 6347 | GGTCTCCA GGCTAGCTACAACGA CACAATCT | 6592 |
| 1037 | UGAUGGAG A CCGUUCCG | 6348 | CGGAACGG GGCTAGCTACAACGA CTCCATCA | 6593 |
| 1040 | UGGAGACC G UUCCGGUG | 5909 | CACCGGAA GGCTAGCTACAACGA GGTCTCCA | 6594 |
| 1046 | CCGUUCCG G UGCUGAAG | 5910 | CTTCAGCA GGCTAGCTACAACGA CGGAACGG | 6595 |
| 1048 | GUUCCGGU G CUGAAGGC | 5911 | GCCTTCAG GGCTAGCTACAACGA ACCGGAAC | 6596 |
| 1055 | UGCUGAAG G CCCAGGCG | 5912 | CGCCTGGG GGCTAGCTACAACGA CTTCAGCA | 6597 |
| 1061 | AGGCCCAG G CGGAUAUC | 5913 | GATATCCG GGCTAGCTACAACGA CTGGGCCT | 6598 |
| 1065 | CCAGGCGG A UAUCUACA | 6349 | TGTAGATA GGCTAGCTACAACGA CCGCCTGG | 6599 |
| 1067 | AGGCGGAU A UCUACAAG | 4438 | CTTGTAGA GGCTAGCTACAACGA ATCGCCT | 6600 |
| 1071 | GGAUAUCU A CAAGGCGG | 4440 | CCGCCTTG GGCTAGCTACAACGA AGATATCC | 6601 |
| 1076 | UCUACAAG G CGGACUUC | 5914 | GAAGTCCG GGCTAGCTACAACGA CTTGTAGA | 6602 |
| 1080 | CAAGGCGG A CUUCCAGG | 6350 | CCTGGAAG GGCTAGCTACAACGA CCGCCTTG | 6603 |
| 1088 | ACUUCCAG G CUGAGAGG | 5915 | CCTCTCAG GGCTAGCTACAACGA CTGGAAGT | 6604 |
| 1096 | GCUGAGAG G CAGGCCCG | 5916 | CGGGCCTG GGCTAGCTACAACGA CTCTCAGC | 6605 |

TABLE VI-continued

Human IKK-gamma DNAzyme and Substrate Sequence

| Pos | Substrate | Seq ID | DNAzyme | Seq ID |
|---|---|---|---|---|
| 1100 | AGAGGCAG G CCCGGGAG | 5917 | CTCCCGGG GGCTAGCTACAACGA CTGCCTCT | 6606 |
| 1111 | CGGGAGAA G CUGGCCGA | 5918 | TCGGCCAG GGCTAGCTACAACGA TTCTCCCG | 6607 |
| 1115 | AGAAGCUG G CCGAGAAG | 5919 | CTTCTCGG GGCTAGCTACAACGA CAGCTTCT | 6608 |
| 1129 | AAGAAGGA G CUCCUGCA | 5920 | TGCAGGAG GGCTAGCTACAACGA TCCTTCTT | 6609 |
| 1135 | GAGCUCCU G CAGGAGCA | 5921 | TGCTCCTG GGCTAGCTACAACGA AGGAGCTC | 6610 |
| 1141 | CUGCAGGA G CAGCUGGA | 5922 | TCCAGCTG GGCTAGCTACAACGA TCCTGCAG | 6611 |
| 1144 | CAGGAGCA G CUGGAGCA | 5923 | TGCTCCAG GGCTAGCTACAACGA TGCTCCTG | 6612 |
| 1150 | CAGCUGGA G CAGCUGCA | 5924 | TGCAGCTG GGCTAGCTACAACGA TCCAGCTG | 6613 |
| 1153 | CUGGAGCA G CUGCAGAG | 5925 | CTCTGCAG GGCTAGCTACAACGA TGCTCCAG | 6614 |
| 1156 | GAGCAGCU G CAGAGGGA | 5926 | TCCCTCTG GGCTAGCTACAACGA AGCTGCTC | 6615 |
| 1165 | CAGAGGGA G UACAGCAA | 5927 | TTGCTGTA GGCTAGCTACAACGA TCCCTCTG | 6616 |
| 1167 | GAGGGAGU A CAGCAAAC | 4444 | GTTTGCTG GGCTAGCTACAACGA ACTCCCTC | 6617 |
| 1170 | GGAGUACA G CAAACUGA | 5928 | TCAGTTTG GGCTAGCTACAACGA TGTACTCC | 6618 |
| 1174 | UACAGCAA A CUGAAGGC | 6351 | GCCTTCAG GGCTAGCTACAACGA TTGCTGTA | 6619 |
| 1181 | AACUGAAG G CCAGCUGU | 5929 | ACAGCTGG GGCTAGCTACAACGA CTTCAGTT | 6620 |
| 1185 | GAAGGCCA G CUGUCAGG | 5930 | CCTGACAG GGCTAGCTACAACGA TGGCCTTC | 6621 |
| 1188 | GGCCAGCU G UCAGGAGU | 5931 | ACTCCTGA GGCTAGCTACAACGA AGCTGGCC | 6622 |
| 1195 | UGUCAGGA G UCGGCCAG | 5932 | CTGGCCGA GGCTAGCTACAACGA TCCTGACA | 6623 |
| 1199 | AGGAGUCG G CCAGGAUC | 5933 | GATCCTGG GGCTAGCTACAACGA CGACTCCT | 6624 |
| 1205 | CGGCCAGG A UCGAGGAC | 6352 | GTCCTCGA GGCTAGCTACAACGA CCTGGCCG | 6625 |
| 1212 | GAUCGAGG A CAUGAGGA | 6353 | TCCTCATG GGCTAGCTACAACGA CCTCGATC | 6626 |
| 1214 | UCGAGGAC A UGAGGAAG | 5017 | CTTCCTCA GGCTAGCTACAACGA GTCCTCGA | 6627 |
| 1222 | AUGAGGAA G CGGCAUGU | 5934 | ACATGCCG GGCTAGCTACAACGA TTCCTCAT | 6628 |
| 1225 | AGGAAGCG G CAUGCGA | 5935 | TCGACATG GGCTAGCTACAACGA CGCTTCCT | 6629 |
| 1227 | GAAGCGGC A UGUCGAGG | 5018 | CCTCGACA GGCTAGCTACAACGA GCCGCTTC | 6630 |
| 1229 | AGCGGCAU G UCGAGGUC | 5936 | GACCTCGA GGCTAGCTACAACGA ATGCCGCT | 6631 |
| 1235 | AUGUCGAG G UCUCCCAG | 5937 | CTGGGAGA GGCTAGCTACAACGA CTCGACAT | 6632 |
| 1244 | UCUCCCAG G CCCCCUUG | 5938 | CAAGGGGG GGCTAGCTACAACGA CTGGGAGA | 6633 |
| 1252 | GCCCCCUU G CCCCCCGC | 5939 | GCGGGGGG GGCTAGCTACAACGA AAGGGGGC | 6634 |
| 1259 | UGCCCCCC G CCUACCUC | 5940 | GGCAGGGG GGCTAGCTACAACGA GGGGGGCA | 6635 |
| 1265 | CCGCCCCU G CCUACCUC | 5941 | GAGGTAGG GGCTAGCTACAACGA AGGGGCGG | 6636 |
| 1269 | CCCUGCCU A CCUCUCCU | 4452 | AGGAGAGG GGCTAGCTACAACGA AGGCAGGG | 6637 |
| 1286 | CUCCCCUG G CCCUGCCC | 5942 | GGGCAGGG GGCTAGCTACAACGA CAGGGGAG | 6638 |
| 1291 | CUGGCCCU G CCCAGCCA | 5943 | TGGCTGGG GGCTAGCTACAACGA AGGGCCAG | 6639 |
| 1296 | CCUGCCCA G CCAGAGGA | 5944 | TCCTCTGG GGCTAGCTACAACGA TGGGCAGG | 6640 |
| 1308 | GAGGAGGA G CCCCCCCG | 5945 | CGGGGGGG GGCTAGCTACAACGA TCCTCCTC | 6641 |
| 1321 | CCCGAGGA G CCACCUGA | 5946 | TCAGGTGG GGCTAGCTACAACGA TCCTCGGG | 6642 |
| 1324 | GAGGAGCC A CCUGACUU | 5064 | AAGTCAGG GGCTAGCTACAACGA GGCTCCTC | 6643 |
| 1329 | GCCACCUG A CUUCUGCU | 6354 | AGCAGAAG GGCTAGCTACAACGA CAGGTGGC | 6644 |
| 1335 | UGACUUUU G CUGUCCCA | 5947 | TGGGACAG GGCTAGCTACAACGA AGAAGTCA | 6645 |
| 1338 | CUUCUGCU G UCCAAGU | 5948 | ACTTGGGA GGCTAGCTACAACGA AGCAGAAG | 6646 |
| 1345 | UGUCCCAA G UGCCAGUA | 5949 | TACTGGCA GGCTAGCTACAACGA TTGGGACA | 6647 |
| 1347 | UCCCAAGU G CCAGUAUC | 5950 | GATACTGG GGCTAGCTACAACGA ACTTGGGA | 6648 |
| 1351 | AAGUGCCA G UAUCAGGC | 5951 | GCCTGATA GGCTAGCTACAACGA TGGCAGTT | 6649 |
| 1353 | GUGCCAGU A UCAGGCCC | 4460 | GGGCCTGA GGCTAGCTACAACGA ACTGGCAC | 6650 |
| 1358 | AGUAUCAG G CCCCUGAU | 5952 | ATCAGGGG GGCTAGCTACAACGA CTGATACT | 6651 |
| 1365 | GGCCCCUG A UAUGGACA | 6355 | TGTCCATA GGCTAGCTACAACGA CAGGGGCC | 6652 |
| 1367 | CCCCUGAU A UGGACACC | 4462 | GGTGTCCA GGCTAGCTACAACGA ATCAGGGG | 6653 |
| 1371 | UGAUAUGG A CACCCUGC | 6356 | GCAGGGTG GGCTAGCTACAACGA CCATATCA | 6654 |
| 1373 | AUAUGGAC A CCCUGCAG | 5080 | CTGCAGGG GGCTAGCTACAACGA GTCCATAT | 6655 |
| 1378 | GACACCCU G CAGAUACA | 5953 | TGTATCTG GGCTAGCTACAACGA AGGGTGTC | 6656 |
| 1382 | CCCUGCAG A UACAUGUC | 6357 | GACATGTA GGCTAGCTACAACGA CTGCAGGG | 6657 |
| 1384 | CUGCAGAU A CAUGUCAU | 4463 | ATGACATG GGCTAGCTACAACGA ATCTGCAG | 6658 |
| 1386 | GCAGAUAC A UGUCAUGG | 5085 | CCATGACA GGCTAGCTACAACGA GTATCTGC | 6659 |
| 1388 | AGAUACAU G UCAUGGAG | 5954 | CTCCATGA GGCTAGCTACAACGA ATGTATCT | 6660 |
| 1391 | UACAUGUC A UGGAGUGC | 5086 | GCACTCCA GGCTAGCTACAACGA GACATGTA | 6661 |
| 1396 | GUCAUGGA G UGCAUUGA | 5955 | TCAATGCA GGCTAGCTACAACGA TCCATGAC | 6662 |
| 1398 | CAUGGAGU G CAUUGAGU | 5956 | ACTCAATG GGCTAGCTACAACGA ACTCCATG | 6663 |
| 1400 | UGGAGUGC A UUGAGUAG | 5087 | CTACTCAA GGCTAGCTACAACGA GCACTCCA | 6664 |
| 1405 | UGCAUUGA G UAGGGCCG | 5957 | CGGCCCTA GGCTAGCTACAACGA TCAATGCA | 6665 |
| 1410 | UGAGUAGG G CCGGCCAG | 5958 | CTGGCCGG GGCTAGCTACAACGA CCTACTCA | 6666 |
| 1414 | UAGGGCCG G CCAGUGCA | 5959 | TGCACTGG GGCTAGCTACAACGA CGGCCCTA | 6667 |
| 1418 | GCCGGCCA G UGCAAGGC | 5960 | GCCTTGCA GGCTAGCTACAACGA TGGCCGGC | 6668 |
| 1420 | CGGCCAGU G CAAGGCCA | 5961 | TGGCCTTG GGCTAGCTACAACGA ACTGGCCG | 6669 |
| 1425 | AGUGCAAG G CCACUGCC | 5962 | GGCAGTGG GGCTAGCTACAACGA CTTGCACT | 6670 |
| 1428 | GCAAGGCC A CUGCCUGC | 5093 | GCAGGCAG GGCTAGCTACAACGA GGCCTTGC | 6671 |
| 1431 | AGGCCACU G CCUGCCCG | 5963 | CGGGCAGG GGCTAGCTACAACGA AGTGGCCT | 6672 |
| 1435 | CACUGCCU G CCCGAGGA | 5964 | TCCTCGGG GGCTAGCTACAACGA AGGCAGTG | 6673 |
| 1443 | GCCCGAGG A CGUGCCCG | 6358 | CGGGCACG GGCTAGCTACAACGA CCTCGGGC | 6674 |
| 1445 | CCGAGGAC G UGCCCGGG | 5965 | CCCGGGCA GGCTAGCTACAACGA GTCCTCGG | 6675 |
| 1447 | GAGGACGU G CCCGGGAC | 5966 | GTCCCGGG GGCTAGCTACAACGA ACGTCCTC | 6676 |
| 1454 | UGCCCGGG A CCGUGCAG | 6359 | CTGCACGG GGCTAGCTACAACGA CCCGGGCA | 6677 |
| 1457 | CCGGGACC G UGCAGUCU | 5967 | AGACTGCA GGCTAGCTACAACGA GGTCCCGG | 6678 |
| 1459 | GGGACCGU G CAGUCUGC | 5968 | GCAGACTG GGCTAGCTACAACGA ACGGTCCC | 6679 |

TABLE VI-continued

Human IKK-gamma DNAzyme and Substrate Sequence

| Pos | Substrate | Seq ID | DNAzyme | Seq ID |
|---|---|---|---|---|
| 1462 | ACCGUGCA G UCUGCGCU | 5969 | AGCGCAGA GGCTAGCTACAACGA TGCACGGT | 6680 |
| 1466 | UGCAGUCU G CGCUUUCC | 5970 | GGAAAGCG GGCTAGCTACAACGA AGACTGCA | 6681 |
| 1468 | CAGUCUGC G CUUUCCUC | 5971 | GAGGAAAG GGCTAGCTACAACGA GCAGACTG | 6682 |
| 1481 | CCUCUCCC G CCUGCCUA | 5972 | TAGGCAGG GGCTAGCTACAACGA GGGAGAGG | 6683 |
| 1485 | UCCCGCCU G CCUACCCC | 5973 | GGGCTAGG GGCTAGCTACAACGA AGCCGGGA | 6684 |
| 1490 | CCUGCCUA G CCCAGGAU | 5974 | ATCCTGGG GGCTAGCTACAACGA TACGCAGG | 6685 |
| 1497 | AGCCCAGG A UGAAGGGC | 6360 | GCCCTTCA GGCTAGCTACAACGA CCTCGGCT | 6686 |
| 1504 | GAUGAAGG G CUGGGUGG | 5975 | CCACCCAG GGCTAGCTACAACGA CCTTCATC | 6687 |
| 1509 | AGGGCUGG G UGCCCACA | 5976 | TCTGGCCA GGCTAGCTACAACGA CCAGCCCT | 6688 |
| 1512 | GCUGGGUG G CCACAACU | 5977 | AGTTGTGG GGCTAGCTACAACGA CACCCACC | 6689 |
| 1515 | GGGUGCCC A CAACUGGC | 5119 | CCCAGTTG GGCTAGCTACAACGA GGGCACCC | 6690 |
| 1518 | UGGCCACA A CUGGGAUC | 6361 | CATCCCAG GGCTAGCTACAACGA TGTCCCCA | 6691 |
| 1524 | CAACUGGG A UGCCACCU | 6362 | AGCTGGCA GGCTAGCTACAACGA CCCAGTTG | 6692 |
| 1526 | ACUGGGAU G CCACCUGG | 5978 | CCAGGTGG GGCTAGCTACAACGA ATCCCAGT | 6693 |
| 1529 | GGGAUGCC A CCUGGAGC | 5123 | GCTCCAGG GGCTAGCTACAACGA GGCATCCC | 6694 |
| 1536 | CACCUGGA G CCCCACCC | 5979 | GGGTGGGG GGCTAGCTACAACGA TCCAGGTG | 6695 |
| 1541 | GGACCCCC A CCCAGGAG | 5129 | CTCCTGGG GGCTAGCTACAACGA GGGGCTCC | 6696 |
| 1549 | ACCCAGGA G CUGGCCGC | 5980 | CCGGCCAG GGCTAGCTACAACGA TCCTGGGT | 6697 |
| 1553 | AGGAGCUG G CCGCGGCA | 5981 | TGCCGCGG GGCTAGCTACAACGA CAGCTCCT | 6698 |
| 1556 | AGCUGGCC G CGGCACCU | 5982 | AGGTGCCG GGCTAGCTACAACGA GGCCAGCT | 6699 |
| 1559 | UGGCCGCC G CACCUUAC | 5983 | GTAAGGTC GGCTAGCTACAACGA CGCCCCCA | 6700 |
| 1561 | GCCGCGCC A CCUUACGC | 5135 | GCGTAAGG GGCTAGCTACAACGA GCCGCGGC | 6701 |
| 1566 | GGCACCUU A CGCUUCAG | 4475 | CTGAAGCG GGCTAGCTACAACGA AAGGTGCC | 6702 |
| 1568 | CACCUUAC G CUUCACCU | 5984 | ACCTGAAG GGCTAGCTACAACGA GTAAGGTG | 6703 |
| 1574 | ACGCUUCA G CUGUUGAU | 5985 | ATCAACAG GGCTAGCTACAACGA TGAAGCGT | 6704 |
| 1577 | CUUCAGCU G UUGAUCCG | 5986 | CGGATCAA GGCTAGCTACAACGA AGCTGAAG | 6705 |
| 1581 | AGCUGUUG A UCCGCUGG | 6363 | CCAGCGGA GGCTAGCTACAACGA CAACAGCT | 6706 |
| 1585 | GUUGAUCC G CUGGUCAC | 5987 | GGGACCAG GGCTAGCTACAACGA GGATCAAC | 6707 |
| 1589 | AUCCGCUG G UCCCCUCU | 5988 | AGAGGGGA GGCTAGCTACAACGA CAGCGGAT | 6708 |
| 1604 | CUUUGGG G UAGAUGCG | 5989 | CGCATCTA GGCTAGCTACAACGA CCCAAAAG | 6709 |
| 1608 | UGGGGUAG A UGCGGCCC | 6364 | GGGCCGCA GGCTAGCTACAACGA CTACCCCA | 6710 |
| 1610 | GGGUAGAU G CGGCCCCG | 5990 | CGGGGCCG GGCTAGCTACAACGA ATCTACCC | 6711 |
| 1613 | UAGAUGCG G CCCCGAUC | 5991 | GATCGGGG GGCTAGCTACAACGA CGCATCTA | 6712 |
| 1619 | CGGCCCCG A UCAGGCCU | 6365 | AGGCCTGA GGCTAGCTACAACGA CGGGGCCG | 6713 |
| 1624 | CCGAUCAG G CCUGACUC | 5992 | GAGTCAGG GGCTAGCTACAACGA CTGATCGG | 6714 |
| 1629 | CAGGCCUG A CUCGCUGC | 6366 | GCAGCGAC GGCTAGCTACAACGA CAGGCCTG | 6715 |
| 1633 | CCUGACUC G CUGCUCUU | 5993 | AAGAGCAG GGCTAGCTACAACGA GAGTCAGG | 6716 |
| 1636 | GACUCGCU G CUCUUUUU | 5994 | AAAAAGAG GGCTAGCTACAACGA AGCGAGTC | 6717 |
| 1645 | CUCUUUUU G UUCCCUUC | 5995 | GAAGGGAA GGCTAGCTACAACGA AAAAAGAG | 6718 |
| 1655 | UCCCUUCU G UCUGCUCG | 5996 | CGAGCAGA GGCTAGCTACAACGA AGAAGGGA | 6719 |
| 1659 | UUCUGUCU G CUCGAACC | 5997 | GGTTCGAC GGCTAGCTACAACGA AGACACAA | 6720 |
| 1665 | CUGCUCGA A CCACUUGC | 6367 | GCAAGTGG GGCTAGCTACAACGA TCGAGCAG | 6721 |
| 1668 | CUCGAACC A CUUGCCUC | 5165 | GAGGCAAG GGCTAGCTACAACGA GGTTCGAG | 6722 |
| 1672 | AACCACUU G CCUCGGGC | 5998 | GCCGCAGG GGCTAGCTACAACGA AAGTGGTT | 6723 |
| 1679 | UGCCUCGG G CUAAUCCC | 5999 | GGGATTAG GGCTAGCTACAACGA CCGAGGCA | 6724 |
| 1683 | UCGGGCUA A UCCCUCCC | 6368 | GGGAGGGA GGCTAGCTACAACGA TAGCCCGA | 6725 |
| 1701 | CUUCCUCC A CCCGGCAC | 5180 | GTGCCGGG GGCTAGCTACAACGA GGAGGAAG | 6726 |
| 1706 | UCCACCCG G CACUGGGG | 6000 | CCCCAGTG GGCTAGCTACAACGA CGGGTGGA | 6727 |
| 1708 | CACCCGGC A CUGGGGAA | 5183 | TTCCCCAG GGCTAGCTACAACGA GCCGGGTG | 6728 |
| 1717 | CUGGGGAA G UCAAGAAU | 6001 | ATTCTTGA GGCTAGCTACAACGA TTCCCCAG | 6729 |
| 1724 | AGUCAAGA A UGGGGCCU | 6369 | AGGCCCCA GGCTAGCTACAACGA TCTTGACT | 6730 |
| 1729 | AGAAUGGG G CCUGGGGC | 6002 | GCCCCAGG GGCTAGCTACAACGA CCCATTCT | 6731 |
| 1736 | GGCCUGGG G CUCUCAGG | 6003 | CCTGAGAG GGCTAGCTACAACGA CCCAGGCC | 6732 |
| 1749 | CAGGGAGA A CUGCUUCC | 6370 | GGAAGCAG GGCTAGCTACAACGA TCTCCCTG | 6733 |
| 1752 | GGAGAACU G CUUCCCCU | 6004 | AGGGGAAG GGCTAGCTACAACGA AGTTCTCC | 6734 |
| 1762 | UUCCCCUG G CAGAGCUG | 6005 | CAGCTCTG GGCTAGCTACAACGA CAGGGGAA | 6735 |
| 1767 | CUGGCAGA G CUGGGUGG | 6006 | CCACCCAG GGCTAGCTACAACGA TCTGCCAG | 6736 |
| 1772 | AGAGCUGG G UGGCAGCU | 6007 | AGCTGCCA GGCTAGCTACAACGA CCAGCTCT | 6737 |
| 1775 | GCUGGGUG G CAGCUCUU | 6008 | AAGAGCTG GGCTAGCTACAACGA CACCCAGC | 6738 |
| 1778 | GGGUGGCA G CUCUUCCU | 6009 | AGGAAGAG GGCTAGCTACAACGA TGCCACCC | 6739 |
| 1790 | UUCCUCCC A CCGGACAC | 5206 | GTGTCCGG GGCTAGCTACAACGA GGGAGGAA | 6740 |
| 1795 | CCCACCGG A CACCGACC | 6371 | GGTCGGTG GGCTAGCTACAACGA CCGGTGGG | 6741 |
| 1797 | CACCGGAC A CCGACCCG | 5208 | CGGGTCGG GGCTAGCTACAACGA GTCCGGTG | 6742 |
| 1801 | GGACACCG A CCCGCCCG | 6372 | CGGGCGGG GGCTAGCTACAACGA CGGTGTCC | 6743 |
| 1805 | ACCGACCC G CCCGCCGC | 6010 | GCGGCGGG GGCTAGCTACAACGA GGGTCGGT | 6744 |
| 1809 | ACCCGCCC G CCGCUGUG | 6011 | CACAGCGG GGCTAGCTACAACGA GGGCGGGT | 6745 |
| 1812 | CGCCCGCC G CUGUGCCC | 6012 | GGGCACAG GGCTAGCTACAACGA GGCGGGCG | 6746 |
| 1815 | CCGCCGCU G UGCCCUGG | 6013 | CCAGGGCA GGCTAGCTACAACGA AGCGGCGG | 6747 |
| 1817 | GCCGCUGU G CCCUGGGA | 6014 | TCCCAGGG GGCTAGCTACAACGA ACAGCGGC | 6748 |
| 1826 | CCCUGGGA G UGCUGCCC | 6015 | GGGCAGCA GGCTAGCTACAACGA TCCCAGGG | 6749 |
| 1828 | CUGGGAGU G CUGCCCUC | 6016 | GAGGGCAG GGCTAGCTACAACGA ACTCCCAG | 6750 |
| 1831 | GGAGUGCU G CCCUCUUA | 6017 | TAAGAGGG GGCTAGCTACAACGA AGCACTCC | 6751 |
| 1839 | GCCCUCUU A CCAUGCAC | 4519 | GTGCATGG GGCTAGCTACAACGA AAGAGGGC | 6752 |
| 1842 | CUCUUACC A UGCACACG | 5225 | CGTGTGCA GGCTAGCTACAACGA GGTAAGAG | 6753 |

TABLE VI-continued

Human IKK-gamma DNAzyme and Substrate Sequence

| Pos | Substrate | Seq ID | DNAzyme | Seq ID |
|---|---|---|---|---|
| 1844 | CUUACCAU G CACACGGG | 6018 | CCCGTGTG GGCTAGCTACAACGA ATGGTAAG | 6754 |
| 1846 | UACCAUGC A CACGGGUG | 5226 | CACCCGTG GGCTAGCTACAACGA GCATGGTA | 6755 |
| 1848 | CCAUGCAC A CGGGUGCU | 5227 | AGCACCCG GGCTAGCTACAACGA GTGCATGG | 6756 |
| 1852 | GCACACGG G UGCUCUCC | 6019 | GGAGAGCA GGCTAGCTACAACGA CCGTGTGC | 6757 |
| 1854 | ACACGGGU G CUCUCCUU | 6020 | AAGGAGAG GGCTAGCTACAACGA ACCCGTGT | 6758 |
| 1867 | CCUUUUGG G CUGCAUGC | 6021 | GCATGCAG GGCTAGCTACAACGA CCAAAAGG | 6759 |
| 1870 | UUUGGGCU G CAUGCUAU | 6022 | ATAGCATG GGCTAGCTACAACGA AGCCCAAA | 6760 |
| 1872 | UGGGCUGC A UGCUAUUC | 5233 | GAATAGCA GGCTAGCTACAACGA GCAGCCCA | 6761 |
| 1874 | GGCUGCAU G CUAUUCCA | 6023 | TGGAATAG GGCTAGCTACAACGA ATGCAGCC | 6762 |
| 1877 | UGCAUGCU A UUCCAUUU | 4525 | AAATGGAA GGCTAGCTACAACGA AGCATGCA | 6763 |
| 1882 | GCUAUUCC A UUUUGCAC | 5236 | CTGCAAAA GGCTAGCTACAACGA GGAATAGC | 6764 |
| 1887 | UCCAUUUU G CAGCCAGA | 6024 | TCTGGCTG GGCTAGCTACAACGA AAAATGGA | 6765 |
| 1890 | AUUUUGCA G CCAGACCG | 6025 | CGGTCTGG GGCTAGCTACAACGA TGCAAAAT | 6766 |
| 1895 | GCAGCCAG A CCGAUGUG | 6373 | CACATCGG GGCTAGCTACAACGA CTGGCTGC | 6767 |
| 1899 | CCAGACCG A UGUAUUU | 6374 | AATACACA GGCTAGCTACAACGA CGGTCTGG | 6768 |
| 1901 | AGACCGAU G UGUAUUUA | 6026 | TAAATACA GGCTAGCTACAACGA ATCGGTCT | 6769 |
| 1903 | ACCGAUGU G UAUUUAAC | 6027 | GTTAAATA GGCTAGCTACAACGA ACATCGGT | 6770 |
| 1905 | CGAUGUGU A UUUAACCA | 4531 | TGGTTAAA GGCTAGCTACAACGA ACACATCG | 6771 |
| 1910 | UGUAUUUA A CCAGUCAC | 6375 | GTGACTGG GGCTAGCTACAACGA TAAATACA | 6772 |
| 1914 | UUUAACCA G UCACUAUU | 6028 | AATAGTGA GGCTAGCTACAACGA TGGTTAAA | 6773 |
| 1917 | AACCAGUC A CUAUUGAU | 5243 | ATCAATAG GGCTAGCTACAACGA GACTGGTT | 6774 |
| 1920 | CAGUCACU A UUGAUGGA | 4536 | TCCATCAA GGCTAGCTACAACGA AGTGACTG | 6775 |
| 1924 | CACUAUUG A UGGACAUU | 6376 | AATGTCCA GGCTAGCTACAACGA CAATAGTG | 6776 |
| 1928 | AUUGAUGG A CAUUUGGG | 6377 | CCCAAATG GGCTAGCTACAACGA CCATCAAT | 6777 |
| 1930 | UGAUGGAC A UUUGGGUU | 5245 | AACCCAAA GGCTAGCTACAACGA GTCCATCA | 6778 |
| 1936 | ACAUUUGG G UUGUUUCC | 6029 | GGAAACAA GGCTAGCTACAACGA CCAAATGT | 6779 |
| 1939 | UUUGGGUU G UUUCCCAU | 6030 | ATGGGAAA GGCTAGCTACAACGA AACCCAAA | 6780 |
| 1946 | UGUUUCCC A UCUUUUUG | 5248 | CAAAAAGA GGCTAGCTACAACGA GGGAAACA | 6781 |
| 1954 | AUCUUUUU G UUACCAUA | 6031 | TATGGTAA GGCTAGCTACAACGA AAAAAGAT | 6782 |
| 1957 | UUUUUGUU A CCAUAAAU | 4550 | ATTTATGG GGCTAGCTACAACGA AACAAAAA | 6783 |
| 1960 | UUGUUACC A UAAAUAAU | 5251 | ATTATTTA GGCTAGCTACAACGA GGTAACAA | 6784 |
| 1964 | UACCAUAA A UAAUGGCA | 6378 | TGCCATTA GGCTAGCTACAACGA TTATGGTA | 6785 |
| 1967 | CAUAAAUA A UGGCAUAG | 6379 | CTATGCCA GGCTAGCTACAACGA TATTTATG | 6786 |
| 1970 | AAAUAAUG G CAUAGUAA | 6032 | TTACTATG GGCTAGCTACAACGA CATTATTT | 6787 |
| 1972 | AUAAUGGC A UAGUAAAA | 5252 | TTTTACTA GGCTAGCTACAACGA GCCATTAT | 6788 |
| 1975 | AUGGCAUA G UAAAAAAA | 6033 | TTTTTTTA GGCTAGCTACAACGA TATGCCAT | 6789 |

Input Sequence = NM_003639. Cut Site = R/Y
Arm Length = 8. Core Sequence = GGCTAGCTACAACGA
NM_003639 (*Homo Sapiens* inhibitor of kappa light polypeptide gene enhancer in B-cells, kinase gamma (IKBKG), mRNA.; 1994 bp)

TABLE VII

Human IKK-gamma Amberzyme and Substrate Sequence

| Pos | Substrate | Seq ID | Amberzyme | Seq ID |
|---|---|---|---|---|
| 12 | ACGAGCAU G GCCCUUGU | 6790 | ACAAGGGC GGAGGAAACUCC CU UCAAGGACAUCGUCCGGG AUGCUCGU | 7142 |
| 13 | CGAGCAUG G CCCUUGUG | 5757 | CACAAGGG GGAGGAAACUCC CU UCAAGGACAUCGUCCGGG CAUGCUCG | 7143 |
| 19 | UGGCCCUU G UGAUCCAG | 5758 | CUGGAUCA GGAGGAAACUCC CU UCAAGGACAUCGUCCGGG AAGGGCCA | 7144 |
| 21 | GCCCUUGU G AUCCAGGU | 6791 | ACCUGGAU GGAGGAAACUCC CU UCAAGGACAUCGUCCGGG ACAAGGGC | 7145 |
| 27 | GUGAUCCA G GUGGGGAA | 6792 | UUCCCCAC GGAGGAAACUCC CU UCAAGGACAUCGUCCGGG UGGAUCAC | 7146 |
| 28 | UGAUCCAG G UGGGGAAA | 5759 | UUUCCCCA GGAGGAAACUCC CU UCAAGGACAUCGUCCGGG CUGGAUCA | 7147 |
| 30 | AUCCAGGU G GGGAAACU | 6793 | AGUUUCCC GGAGGAAACUCC CU UCAAGGACAUCGUCCGGG ACCUGGAU | 7148 |
| 31 | UCCAGGUG G GGAAACUA | 6794 | UAGUUUCC GGAGGAAACUCC CU UCAAGGACAUCGUCCGGG CACCUGGA | 7149 |
| 32 | CCAGGUGG G GAAACUAA | 6795 | UUAGUUUC GGAGGAAACUCC CU UCAAGGACAUCGUCCGGG CCACCUGG | 7150 |
| 33 | CAGGUGGG G AAACUAAG | 6796 | CUUAGUUU GGAGGAAACUCC CU UCAAGGACAUCGUCCGGG CCCACCUG | 7151 |
| 41 | GAAACUAA G GCCCAGAG | 6797 | CUCUGGGC GGAGGAAACUCC CU UCAAGGACAUCGUCCGGG UUAGUUUC | 7152 |
| 42 | AAACUAAG G CCCAGAGA | 5760 | UCUCUGGG GGAGGAAACUCC CU UCAAGGACAUCGUCCGGG CUUAGUUU | 7153 |
| 47 | AAGGCCCA G AGAAGUGA | 6798 | UCACUUCU GGAGGAAACUCC CU UCAAGGACAUCGUCCGGG UGGGCCUU | 7154 |
| 49 | GGCCCAGA G AAGUGAGG | 6799 | CCUCACUU GGAGGAAACUCC CU UCAAGGACAUCGUCCGGG UCUGGGCC | 7155 |
| 52 | CCAGAGAA G UGAGGACC | 5761 | GGUCCUCA GGAGGAAACUCC CU UCAAGGACAUCGUCCGGG UUCUCUGG | 7156 |
| 54 | AGAGAAGU G AGGACCCC | 6800 | GGGGUCCU GGAGGAAACUCC CU UCAAGGACAUCGUCCGGG ACUUCUCU | 7157 |
| 56 | AGAAGUGA G GACCCCGC | 6801 | GCGGGGUC GGAGGAAACUCC CU UCAAGGACAUCGUCCGGG UCACUUCU | 7158 |
| 57 | GAAGUGAG G ACCCCGCA | 6802 | UGCGGGGU GGAGGAAACUCC CU UCAAGGACAUCGUCCGGG CUCACUUC | 7159 |
| 63 | AGGACCCC G CAGACAUG | 5762 | AUAGUCUG GGAGGAAACUCC CU UCAAGGACAUCGUCCGGG GGGGUCCU | 7160 |
| 66 | ACCCCGCA G ACUAUCAA | 6803 | UUGAUAGU GGAGGAAACUCC CU UCAAGGACAUCGUCCGGG UGCGGGGU | 7161 |
| 80 | CAAUCCCA G UCUCUUCC | 5763 | GGAAGAGA GGAGGAAACUCC CU UCAAGGACAUCGUCCGGG UGGGAUUG | 7162 |
| 100 | CACUCCCU G UGAAGCUC | 5764 | GAGCUUCA GGAGGAAACUCC CU UCAAGGACAUCGUCCGGG AGGGAGUG | 7163 |
| 102 | CUCCCUGU G AAGCUCUC | 6804 | GAGAGCUU GGAGGAAACUCC CU UCAAGGACAUCGUCCGGG ACAGGGAG | 7164 |
| 105 | CCUGUGAA G CUCUCCAG | 5765 | CUGGAGAG GGAGGAAACUCC CU UCAAGGACAUCGUCCGGG UUCACAGG | 7165 |

TABLE VII-continued

Human IKK-gamma Amberzyme and Substrate Sequence

| Pos | Substrate | | | Seq ID | Amberzyme | | | | Seq ID |
|---|---|---|---|---|---|---|---|---|---|
| 113 | GCUCUCCA | G | CAUCAUCG | 5766 | CGAUGAUG | GGAGGAAACUCC | CU | UCAAGGACAUCGUCCGGG | UGGAGAGC | 7166 |
| 121 | GCAUCAUC | G | AGGUCCCA | 6805 | UGGGACCU | GGAGGAAACUCC | CU | UCAAGGACAUCGUCCGGG | GAUGAUGC | 7167 |
| 123 | AUCAUCGA | G | GUCCCAUC | 6806 | GAUGGGAC | GGAGGAAACUCC | CU | UCAAGGACAUCGUCCGGG | UCGAUGAU | 7168 |
| 124 | UCAUCGAG | G | UCCCAUCA | 5767 | UGAUGGGA | GGAGGAAACUCC | CU | UCAAGGACAUCGUCCGGG | CUCGAUGA | 7169 |
| 133 | UCCCAUCA | G | CCCUUGCC | 5768 | GGCAAGGG | GGAGGAAACUCC | CU | UCAAGGACAUCGUCCGGG | UGAUGGGA | 7170 |
| 139 | CAGCCCUU | G | CCCUGUUG | 5769 | CAACAGGG | GGAGGAAACUCC | CU | UCAAGGACAUCGUCCGGG | AAGGGCUG | 7171 |
| 144 | CUUGCCCU | G | UUGGAUGA | 5770 | UCAUCCAA | GGAGGAAACUCC | CU | UCAAGGACAUCGUCCGGG | AGGGCAAG | 7172 |
| 147 | GCCCUGUU | G | GAUGAAUA | 6807 | UAUUCAUC | GGAGGAAACUCC | CU | UCAAGGACAUCGUCCGGG | AACAGGGC | 7173 |
| 148 | CCCUGUUG | G | AUGAAUAG | 6808 | CUAUUCAU | GGAGGAAACUCC | CU | UCAAGGACAUCGUCCGGG | CAACAGGG | 7174 |
| 151 | UGUUGGAU | G | AAUAGGCA | 6809 | UGCCUAUU | GGAGGAAACUCC | CU | UCAAGGACAUCGUCCGGG | AUCCAACA | 7175 |
| 156 | GAUGAAUA | G | GCACCUCU | 6810 | AGAGGUGC | GGAGGAAACUCC | CU | UCAAGGACAUCGUCCGGG | UAUUCAUC | 7176 |
| 157 | AUGAAUAG | G | CACCUCUG | 5771 | CAGAGGUG | GGAGGAAACUCC | CU | UCAAGGACAUCGUCCGGG | CUAUUCAU | 7177 |
| 165 | GCACCUCU | G | GAAGAGCC | 6811 | GGCUCUUC | GGAGGAAACUCC | CU | UCAAGGACAUCGUCCGGG | AGAGGUGC | 7178 |
| 166 | CACCUCUG | G | AAGAGCCA | 6812 | UGGCUCUU | GGAGGAAACUCC | CU | UCAAGGACAUCGUCCGGG | CAGAGGUG | 7179 |
| 169 | CUCUGGAA | G | AGCCAACU | 6813 | AGUUGGCU | GGAGGAAACUCC | CU | UCAAGGACAUCGUCCGGG | UUCCAGAG | 7180 |
| 171 | CUGGAAGA | G | CCAACUGU | 5772 | ACAGUUGG | GGAGGAAACUCC | CU | UCAAGGACAUCGUCCGGG | UCUUCCAG | 7181 |
| 178 | AGCCAACU | G | UGUGAGAU | 5773 | AUCUCACA | GGAGGAAACUCC | CU | UCAAGGACAUCGUCCGGG | AGUUGGCU | 7182 |
| 180 | CCAACUGU | G | UGAGAUGG | 5774 | CCAUCUCA | GGAGGAAACUCC | CU | UCAAGGACAUCGUCCGGG | ACAGUUGG | 7183 |
| 182 | AACUGUGU | G | AGAUGGUG | 6814 | CACCAUCU | GGAGGAAACUCC | CU | UCAAGGACAUCGUCCGGG | ACACAGUU | 7184 |
| 184 | CUGUGUGA | G | AUGGUGCA | 6815 | UGCACCAU | GGAGGAAACUCC | CU | UCAAGGACAUCGUCCGGG | UCACACAG | 7185 |
| 187 | UGUGAGAU | G | GUGCAGCC | 6816 | GGCUGCAC | GGAGGAAACUCC | CU | UCAAGGACAUCGUCCGGG | AUCUCACA | 7186 |
| 188 | GUGAGAUG | G | UGCAGCCC | 5775 | GGGCUGCA | GGAGGAAACUCC | CU | UCAAGGACAUCGUCCGGG | CAUCUCAC | 7187 |
| 190 | GAGAUGGU | G | CAGCCCAG | 5776 | CUGGGCUG | GGAGGAAACUCC | CU | UCAAGGACAUCGUCCGGG | ACCAUCUC | 7188 |
| 193 | AUGGUGCA | G | CCCAGUGG | 5777 | CCACUGGG | GGAGGAAACUCC | CU | UCAAGGACAUCGUCCGGG | UGCACCAU | 7189 |
| 198 | GCAGCCCA | G | UGGCCCGG | 5778 | GGCCACCA | GGAGGAAACUCC | CU | UCAAGGACAUCGUCCGGG | UGGGCUGC | 7190 |
| 200 | AGCCCAGU | G | GUGGCCCG | 6817 | CGGGCCAC | GGAGGAAACUCC | CU | UCAAGGACAUCGUCCGGG | ACUGGGCU | 7191 |
| 201 | GCCCAGUG | G | UGGCCCGG | 5779 | CCGGGCCA | GGAGGAAACUCC | CU | UCAAGGACAUCGUCCGGG | CACUGGGC | 7192 |
| 203 | CCAGUGGU | G | GCCCGGCA | 6818 | UGCCGGGC | GGAGGAAACUCC | CU | UCAAGGACAUCGUCCGGG | ACCACUGG | 7193 |
| 204 | CAGUGGUG | G | CCCGGCAG | 5780 | CUGCCGGG | GGAGGAAACUCC | CU | UCAAGGACAUCGUCCGGG | CACCACUG | 7194 |
| 208 | GGUGGCCC | G | GCAGCAGA | 6819 | UCUGCUGC | GGAGGAAACUCC | CU | UCAAGGACAUCGUCCGGG | GGGCCACC | 7195 |
| 209 | GUGGCCCG | G | CAGCAGAU | 5781 | AUCUGCUG | GGAGGAAACUCC | CU | UCAAGGACAUCGUCCGGG | CGGGCCAC | 7196 |
| 212 | GCCCGGCA | G | CAGAUCAG | 5782 | CUGAUCUG | GGAGGAAACUCC | CU | UCAAGGACAUCGUCCGGG | UGCCGGGC | 7197 |
| 215 | CGGCAGCA | G | AUCAGGAC | 6820 | GUCCUGAU | GGAGGAAACUCC | CU | UCAAGGACAUCGUCCGGG | UGCUGCCG | 7198 |
| 220 | GCAGAUCA | G | GACGUACU | 6821 | AGUACCUC | GGAGGAAACUCC | CU | UCAAGGACAUCGUCCGGG | UGAUCUGC | 7199 |
| 221 | CAGAUCAG | G | ACGUACUG | 6822 | CAGUACGU | GGAGGAAACUCC | CU | UCAAGGACAUCGUCCGGG | CUGAUCUG | 7200 |
| 224 | AUCAGGAC | G | UACUGGGC | 5783 | GCCCAGUA | GGAGGAAACUCC | CU | UCAAGGACAUCGUCCGGG | GUCCUGAU | 7201 |
| 229 | GACGUACU | G | GGCGAAGA | 6823 | UCUUCGCC | GGAGGAAACUCC | CU | UCAAGGACAUCGUCCGGG | AGUACGUC | 7202 |
| 230 | ACGUACUG | G | GCGAAGAG | 6824 | CUCUUCGC | GGAGGAAACUCC | CU | UCAAGGACAUCGUCCGGG | CAGUACGU | 7203 |
| 231 | CGUACUGG | G | CGAAGAGU | 5784 | ACUCUUCG | GGAGGAAACUCC | CU | UCAAGGACAUCGUCCGGG | CCAGUACG | 7204 |
| 233 | UACUGGGC | G | AAGAGUCU | 6825 | AGACUCUU | GGAGGAAACUCC | CU | UCAAGGACAUCGUCCGGG | GCCCAGUA | 7205 |
| 236 | UGGGCGAA | G | AGUCUCU | 6826 | AGGAGACU | GGAGGAAACUCC | CU | UCAAGGACAUCGUCCGGG | UUCGCCCA | 7206 |
| 238 | GGCGAAGA | G | UCCCUCU | 5785 | AGAGGAGA | GGAGGAAACUCC | CU | UCAAGGACAUCGUCCGGG | UCUUCGCC | 7207 |
| 247 | UCUCCUCU | G | GGGAAGCC | 6827 | GGCUUCCC | GGAGGAAACUCC | CU | UCAAGGACAUCGUCCGGG | AGAGGAGA | 7208 |
| 248 | CUCCUCUG | G | GAAGCCA | 6828 | UGGCUUCC | GGAGGAAACUCC | CU | UCAAGGACAUCGUCCGGG | CAGAGGAG | 7209 |
| 249 | UCCUCUGG | G | AAGCCAG | 6829 | CUGGCUUC | GGAGGAAACUCC | CU | UCAAGGACAUCGUCCGGG | CCAGAGGA | 7210 |
| 250 | CCUCUGGG | A | AGCCAGC | 6830 | GCUGGCUU | GGAGGAAACUCC | CU | UCAAGGACAUCGUCCGGG | CCCAGAGG | 7211 |
| 253 | CUGGGAA | G | CCAGCAU | 5786 | AUGGCUGG | GGAGGAAACUCC | CU | UCAAGGACAUCGUCCGGG | UUCCCCAG | 7212 |
| 257 | GGAAGCCA | G | CCAUGCUG | 5787 | CAGCAUGG | GGAGGAAACUCC | CU | UCAAGGACAUCGUCCGGG | UGGCUUCC | 7213 |
| 262 | CCAGCCAU | G | CUGCACCU | 5788 | AGGUCCAG | GGAGGAAACUCC | CU | UCAAGGACAUCGUCCGGG | AUGGCUGG | 7214 |
| 265 | GCCAUGCU | G | CACCUGCC | 5789 | GGCAGGUG | GGAGGAAACUCC | CU | UCAAGGACAUCGUCCGGG | AGCAUGGC | 7215 |
| 271 | CUGCACCU | G | CCUUCAGA | 5790 | UCUGAAGG | GGAGGAAACUCC | CU | UCAAGGACAUCGUCCGGG | AGGUCCAG | 7216 |
| 278 | UGCCUUCA | G | AACAGGGC | 6831 | GCCCUGUU | GGAGGAAACUCC | CU | UCAAGGACAUCGUCCGGG | UGAAGGCA | 7217 |
| 283 | UCAGAACA | G | GGCGCUCC | 6832 | CCACCCCC | GGAGGAAACUCC | CU | UCAAGGACAUCGUCCGGG | UGUUCUCA | 7218 |
| 284 | CAGAACAG | G | CCCCUCCU | 6833 | AGGAGCCC | GGAGGAAACUCC | CU | UCAAGGACAUCGUCCGGG | CUGUUCUG | 7219 |
| 285 | AGAACAGG | G | CGCUCCUC | 5791 | CACCAGCG | GGAGGAAACUCC | CU | UCAAGGACAUCGUCCGGG | CCUGUUCU | 7220 |
| 287 | AACAGGGC | G | CUCCUCAC | 5792 | CUCAGGAG | GGAGGAAACUCC | CU | UCAAGGACAUCGUCCGGG | GCCCUGUU | 7221 |
| 293 | GCGCUCCU | C | AGACCCUC | 6834 | GAGGGUCU | GGAGGAAACUCC | CU | UCAAGGACAUCGUCCGGG | AGGACCCC | 7222 |
| 295 | GCUCCUGA | G | ACCCUCCA | 6835 | UCGAGGGU | GGAGGAAACUCC | CU | UCAAGGACAUCGUCCGGG | UCAGGAGC | 7223 |
| 304 | ACCCUCCA | G | CGCUCCCU | 5793 | ACGCAGCG | GGAGGAAACUCC | CU | UCAAGGACAUCGUCCGGG | UCCAGGGU | 7224 |
| 306 | CCUCCAGC | G | CUCCCUGG | 5794 | CCAGGCAC | GGAGGAAACUCC | CU | UCAAGGACAUCGUCCGGG | CCUGGACC | 7225 |
| 309 | CCACCGCU | C | CCUGGAGG | 5795 | CCUCCACC | GGAGGAAACUCC | CU | UCAAGGACAUCGUCCGGG | AGCGCUGG | 7226 |
| 313 | CGCUCCCU | G | GAGGAGAU | 6836 | UUCUCCUC | GGAGGAAACUCC | CU | UCAAGGACAUCGUCCGGG | AGCCAGCC | 7227 |
| 314 | GCUGCCUC | G | AGGAGAAU | 6837 | AUUCUCCU | GGAGGAAACUCC | CU | UCAAGGACAUCGUCCGGG | CAGCCAGC | 7228 |
| 316 | UGCCUGCA | G | GAGAAUCA | 6838 | UCAUUCUC | GGAGGAAACUCC | CU | UCAAGGACAUCGUCCGGG | UCCACCCA | 7229 |
| 317 | CCCUCCAC | G | AGAAUCAA | 6839 | UUCAUUCU | GGAGGAAACUCC | CU | UCAAGGACAUCGUCCGGG | CUCCACCC | 7230 |
| 319 | CUGGACCA | G | AAUCAAGA | 6840 | UCUUGAUU | GGAGGAAACUCC | CU | UCAAGGACAUCGUCCGGG | UCCUCCAG | 7231 |
| 326 | AGAAUCAA | G | ACCUCCCA | 6841 | UCCCACCU | GGAGGAAACUCC | CU | UCAAGGACAUCGUCCGGG | UUGAUUCU | 7232 |
| 328 | AAUCAAGA | G | CUCCCACA | 5796 | UCUCCCAC | GGAGGAAACUCC | CU | UCAAGGACAUCGUCCGGG | UCUUGAUU | 7233 |
| 333 | ACACCUCC | G | ACAUGCCA | 6842 | UCCCAUCU | GGAGGAAACUCC | CU | UCAAGGACAUCGUCCGGG | CGACCUCU | 7234 |
| 335 | ACCUCCCA | G | AUCCCAUC | 6843 | CAUCCCAU | GGAGGAAACUCC | CU | UCAAGGACAUCGUCCGGG | UCCCACCU | 7235 |
| 338 | UCCCACAU | G | CCAUCCCC | 5797 | CCCCAUCC | GGAGGAAACUCC | CU | UCAAGGACAUCGUCCGGG | AUCUCGGA | 7236 |
| 345 | UGCCAUCC | G | GCAGAGCA | 6844 | UGCUCUGC | GGAGGAAACUCC | CU | UCAAGGACAUCGUCCGGG | GGAUGGCA | 7237 |
| 346 | GCCAUCCG | G | CAGAGCAA | 5798 | UUGCUCUG | GGAGGAAACUCC | CU | UCAAGGACAUCGUCCGGG | CGGAUGGC | 7238 |
| 349 | AUCCGGCA | G | AGCAACCA | 6845 | UGGUUGCU | GGAGGAAACUCC | CU | UCAAGGACAUCGUCCGGG | UGCCGGAU | 7239 |
| 351 | CCGGCAGA | G | CAACCAGA | 5799 | UCUGGUUG | GGAGGAAACUCC | CU | UCAAGGACAUCGUCCGGG | UCUGCCGG | 7240 |

TABLE VII-continued

Human IKK-gamma Amberzyme and Substrate Sequence

| Pos | Substrate | Seq ID | Amberzyme | Seq ID |
|---|---|---|---|---|
| 358 | AGCAACCA G AUUCUGCG | 6846 | CGCAGAAU GGAGGAAACUCC CU UCAAGGACAUCGUCCGGG UGGUUGCU | 7241 |
| 364 | CAGAUUCU G CGGGAGCG | 5800 | CGCUCCCG GGAGGAAACUCC CU UCAAGGACAUCGUCCGGG AGAAUCUG | 7242 |
| 366 | GAUUCUGC G GGAGCGCU | 6847 | AGCGCUCC GGAGGAAACUCC CU UCAAGGACAUCGUCCGGG GCAGAAUC | 7243 |
| 367 | AUUCUGCG G GAGCGCUG | 6848 | CAGCGCUC GGAGGAAACUCC CU UCAAGGACAUCGUCCGGG CGCAGAAU | 7244 |
| 368 | UUCUGCGG G AGCGCUGC | 6849 | GCAGCGCU GGAGGAAACUCC CU UCAAGGACAUCGUCCGGG CCGCAGAA | 7245 |
| 370 | CUGCGGGA G CGCUGCGA | 5801 | UCGCAGCG GGAGGAAACUCC CU UCAAGGACAUCGUCCGGG UCCCGCAG | 7246 |
| 372 | GCGGGAGC G CUGCGAGG | 5802 | CCUCGCAG GGAGGAAACUCC CU UCAAGGACAUCGUCCGGG GCUCCCGC | 7247 |
| 375 | GGAGCGCU G CGAGGAGC | 5803 | GCUCCUCG GGAGGAAACUCC CU UCAAGGACAUCGUCCGGG AGCGCUCC | 7248 |
| 377 | AGCGCUGC G AGGAGCUU | 6850 | AAGCUCCU GGAGGAAACUCC CU UCAAGGACAUCGUCCGGG GCAGCGCU | 7249 |
| 379 | CGCUGCGA G GAGCUUCU | 6851 | AGAAGCUC GGAGGAAACUCC CU UCAAGGACAUCGUCCGGG UCGCAGCG | 7250 |
| 380 | GCUGCGAG G AGCUUCUG | 6852 | CAGAAGCU GGAGGAAACUCC CU UCAAGGACAUCGUCCGGG CUCGCAGC | 7251 |
| 382 | UGCGAGGA G CUUCUGCA | 5804 | UGCAGAAG GGAGGAAACUCC CU UCAAGGACAUCGUCCGGG UCCUCGCA | 7252 |
| 388 | GAGCUUCU G CAUUUCCA | 5805 | UGGAAAUG GGAGGAAACUCC CU UCAAGGACAUCGUCCGGG AGAAGCUC | 7253 |
| 398 | AUUUCCAA G CCAGCCAG | 5806 | CUGGCUGG GGAGGAAACUCC CU UCAAGGACAUCGUCCGGG UUGGAAAU | 7254 |
| 402 | CCAAGCCA G CCAGAGGG | 5807 | CCCUCUGG GGAGGAAACUCC CU UCAAGGACAUCGUCCGGG UGGCUUGG | 7255 |
| 406 | GCCAGCCA G AGGGAGGA | 6853 | UCCUCCCU GGAGGAAACUCC CU UCAAGGACAUCGUCCGGG UGGCUGGC | 7256 |
| 408 | CAGCCAGA G GGAGGAGA | 6854 | UCUCCUCC GGAGGAAACUCC CU UCAAGGACAUCGUCCGGG UCUGGCUG | 7257 |
| 409 | AGCCAGAG G GAGGAGAA | 6855 | UUCUCCUC GGAGGAAACUCC CU UCAAGGACAUCGUCCGGG CUCUGGCU | 7258 |
| 410 | GCCAGAGG G AGGAGAAG | 6856 | CUUCUCCU GGAGGAAACUCC CU UCAAGGACAUCGUCCGGG CCUCUGGC | 7259 |
| 412 | CAGAGGGA G GAGAAGGA | 6857 | UCCUUCUC GGAGGAAACUCC CU UCAAGGACAUCGUCCGGG UCCCUCUG | 7260 |
| 413 | AGAGGGAG G AGAAGGAG | 6858 | CUCCUUCU GGAGGAAACUCC CU UCAAGGACAUCGUCCGGG CUCCCUCU | 7261 |
| 415 | AGGGAGGA G AAGGAGUU | 6859 | AACUCCUU GGAGGAAACUCC CU UCAAGGACAUCGUCCGGG UCCUCCCU | 7262 |
| 418 | GAGGAGAA G GAGUUCCU | 6860 | AGGAACUC GGAGGAAACUCC CU UCAAGGACAUCGUCCGGG UUCUCCUC | 7263 |
| 419 | AGGAGAAG G AGUUCCUC | 6861 | GAGGAACU GGAGGAAACUCC CU UCAAGGACAUCGUCCGGG CUUCUCCU | 7264 |
| 421 | GAGAAGGA G UUCCUCAU | 5808 | AUGAGGAA GGAGGAAACUCC CU UCAAGGACAUCGUCCGGG UCCUUCUC | 7265 |
| 430 | UUCCUCAU G UGCAAGUU | 5809 | AACUUGCA GGAGGAAACUCC CU UCAAGGACAUCGUCCGGG AUGAGGAA | 7266 |
| 432 | CCUCAUGU G CAAGUUCC | 5810 | GGAACUUG GGAGGAAACUCC CU UCAAGGACAUCGUCCGGG ACAUGAGG | 7267 |
| 436 | AUGUGCAA G UUCCAGGA | 5811 | UCCUGGAA GGAGGAAACUCC CU UCAAGGACAUCGUCCGGG UUGCACAU | 7268 |
| 442 | AAGUUCCA G AGGCCAG | 6862 | CUGGCCUC GGAGGAAACUCC CU UCAAGGACAUCGUCCGGG UGGAACUU | 7269 |
| 443 | AGUUCCAG G AGGCCAGG | 6863 | CCUGGCCU GGAGGAAACUCC CU UCAAGGACAUCGUCCGGG CUGGAACU | 7270 |
| 445 | UUCCAGGA G GCCAGGAA | 6864 | UUCCUGGC GGAGGAAACUCC CU UCAAGGACAUCGUCCGGG UCCUGGAA | 7271 |
| 446 | UCCAGGAG G CCAGGAAA | 5812 | UUUCCUGG GGAGGAAACUCC CU UCAAGGACAUCGUCCGGG CUCCUGGA | 7272 |
| 450 | GGAGGCCA G GAAACUGG | 6865 | CCAGUUUC GGAGGAAACUCC CU UCAAGGACAUCGUCCGGG UGGCCUCC | 7273 |
| 451 | GAGGCCAG G AAACUGGU | 6866 | ACCAGUUU GGAGGAAACUCC CU UCAAGGACAUCGUCCGGG CUGGCCUC | 7274 |
| 457 | AGGAAACU G UGGAGAG | 6867 | CUCUCCAC GGAGGAAACUCC CU UCAAGGACAUCGUCCGGG AGUUUCCU | 7275 |
| 458 | GGAAACUG G UGGAGAGA | 5813 | UCUCUCCA GGAGGAAACUCC CU UCAAGGACAUCGUCCGGG CAGUUUCC | 7276 |
| 460 | AAACUGGU G AGAGACU | 6868 | AGUCUCUC GGAGGAAACUCC CU UCAAGGACAUCGUCCGGG ACCAGUUU | 7277 |
| 461 | AACUGGUG G AGACUCG | 6869 | GAGUCUCU GGAGGAAACUCC CU UCAAGGACAUCGUCCGGG CACCAGUU | 7278 |
| 463 | CUGGUGGA G AGACUCGG | 6870 | CCGAGUCU GGAGGAAACUCC CU UCAAGGACAUCGUCCGGG UCCACCAG | 7279 |
| 465 | GGUGGAGA G ACUCGGCC | 6871 | GGCCGAGU GGAGGAAACUCC CU UCAAGGACAUCGUCCGGG UCUCCACC | 7280 |
| 470 | AGAGACUC G GCCUGGAG | 6872 | CUCCAGGC GGAGGAAACUCC CU UCAAGGACAUCGUCCGGG GAGUCUCU | 7281 |
| 471 | GAGACUCG G CCUGGAGA | 5814 | UCUCCAGG GGAGGAAACUCC CU UCAAGGACAUCGUCCGGG CGAGUCUC | 7282 |
| 475 | CUCGGCCU G GAGAAGCU | 6873 | AGCUUCUC GGAGGAAACUCC CU UCAAGGACAUCGUCCGGG AGGCCGAG | 7283 |
| 476 | UCGGCCUG G AGAAGCUC | 6874 | GAGCUUCU GGAGGAAACUCC CU UCAAGGACAUCGUCCGGG CAGGCCGA | 7284 |
| 478 | GGCCUGGA G AAGCUCGA | 6875 | UCGAGCUU GGAGGAAACUCC CU UCAAGGACAUCGUCCGGG UCCAGGCC | 7285 |
| 481 | CUGGAGAA G CUCGAUCU | 5815 | AGAUCGAG GGAGGAAACUCC CU UCAAGGACAUCGUCCGGG UUCUCCAG | 7286 |
| 485 | AGAAGCUC G AUCUGAAG | 6876 | CUUCAGAU GGAGGAAACUCC CU UCAAGGACAUCGUCCGGG GAGCUUCU | 7287 |
| 490 | CUCGAUCU G AAGAGGCA | 6877 | UGCCUCUU GGAGGAAACUCC CU UCAAGGACAUCGUCCGGG AGAUGGAG | 7288 |
| 493 | CAUCUGAA G AGGCAGAA | 6878 | UUCUGCCU GGAGGAAACUCC CU UCAAGGACAUCGUCCGGG UUCAGAUC | 7289 |
| 495 | UCUGAAGA G GCAGAAGG | 6879 | CCUUCUGC GGAGGAAACUCC CU UCAAGGACAUCGUCCGGG UCUUCAGA | 7290 |
| 496 | CUGAAGAG G CAGAAGGA | 5816 | UCCUUCUG GGAGGAAACUCC CU UCAAGGACAUCGUCCGGG CUCUUCAG | 7291 |
| 499 | AAGAGGCA G AAGGAGCA | 6880 | UGCUCCUU GGAGGAAACUCC CU UCAAGGACAUCGUCCGGG UGCCUCUU | 7292 |
| 502 | AGGCAGAA G GAGCAGGC | 6881 | GCCUGCUC GGAGGAAACUCC CU UCAAGGACAUCGUCCGGG UUCUGCCU | 7293 |
| 503 | GGCAGAAG G AGCAGGCU | 6882 | AGCCUGCU GGAGGAAACUCC CU UCAAGGACAUCGUCCGGG CUUCUGCC | 7294 |
| 505 | CAGAAGGA G CAGGCUCU | 5817 | AGAGCCUG GGAGGAAACUCC CU UCAAGGACAUCGUCCGGG UCCUUCUG | 7295 |
| 508 | AAGGAGCA G CUCUGCG | 6883 | CGCAGAGC GGAGGAAACUCC CU UCAAGGACAUCGUCCGGG UGCUCCUU | 7296 |
| 509 | AGGAGCAG G CUCUGCGG | 5818 | CCGCAGAG GGAGGAAACUCC CU UCAAGGACAUCGUCCGGG CUGCUCCU | 7297 |
| 514 | CAGGCUCU G CGGGAGGU | 5819 | ACCUCCCG GGAGGAAACUCC CU UCAAGGACAUCGUCCGGG AGAGCCUG | 7298 |
| 516 | GGCUCUGC G GGAGGUGG | 6884 | CCACCUCC GGAGGAAACUCC CU UCAAGGACAUCGUCCGGG GCAGAGCC | 7299 |
| 517 | GCUCUGCG G GAGGUGGA | 6885 | UCCACCUC GGAGGAAACUCC CU UCAAGGACAUCGUCCGGG CGCAGAGC | 7300 |
| 518 | CUCUGCGG G AGGUGGAG | 6886 | CUCCACCU GGAGGAAACUCC CU UCAAGGACAUCGUCCGGG CCGCAGAG | 7301 |
| 520 | CUGCGGGA G GUGGAGCA | 6887 | UGCUCCAC GGAGGAAACUCC CU UCAAGGACAUCGUCCGGG UCCCGCAG | 7302 |
| 521 | UGCGGGAG G UGGAGCAC | 5820 | GUGCUCCA GGAGGAAACUCC CU UCAAGGACAUCGUCCGGG CUCCCGCA | 7303 |
| 523 | CGGGAGGU G AGCACCU | 6888 | AGGUCCUC GGAGGAAACUCC CU UCAAGGACAUCGUCCGGG ACCUCCCG | 7304 |
| 524 | GGGAGGUG G AGCACCUG | 6889 | CAGGUGCU GGAGGAAACUCC CU UCAAGGACAUCGUCCGGG CACCUCCC | 7305 |
| 526 | GAGGUGGA G CACCUGAA | 5821 | UUCAGGUG GGAGGAAACUCC CU UCAAGGACAUCGUCCGGG UCCACCUC | 7306 |
| 532 | GAGCACCU G AAGAGAUG | 6890 | CAUCUCUU GGAGGAAACUCC CU UCAAGGACAUCGUCCGGG AGGUCCUC | 7307 |
| 535 | CACCUGAA G AGAUGCCA | 6891 | UGGCAUCU GGAGGAAACUCC CU UCAAGGACAUCGUCCGGG UUCAGGUG | 7308 |
| 537 | CCUGAAGA G AUGCCAGC | 6892 | GCUGGCAU GGAGGAAACUCC CU UCAAGGACAUCGUCCGGG UCUUCAGG | 7309 |
| 540 | GAAGAGAU G CCAGCAGC | 5822 | GCUGCUGG GGAGGAAACUCC CU UCAAGGACAUCGUCCGGG AUCUCUUC | 7310 |
| 544 | AGAUGCCA G CAGCAGAU | 5823 | AUCUGCUG GGAGGAAACUCC CU UCAAGGACAUCGUCCGGG UGGCAUCU | 7311 |
| 547 | UGCCAGCA G CAGAUGGC | 5824 | GCCAUCUG GGAGGAAACUCC CU UCAAGGACAUCGUCCGGG UGCUGGCA | 7312 |
| 550 | CAGCAGCA G AUGGCUGA | 6893 | UCAGCCAU GGAGGAAACUCC CU UCAAGGACAUCGUCCGGG UGCUGCUG | 7313 |
| 553 | CAGCAGAU G GCUGAGGA | 6894 | UCCUCAGC GGAGGAAACUCC CU UCAAGGACAUCGUCCGGG AUCUGCUG | 7314 |
| 554 | AGCAGAUG G CUGAGGAC | 5825 | GUCCUCAG GGAGGAAACUCC CU UCAAGGACAUCGUCCGGG CAUCUGCU | 7315 |

TABLE VII-continued

Human IKK-gamma Amberzyme and Substrate Sequence

| Pos | Substrate | Seq ID | Amberzyme | Seq ID |
|---|---|---|---|---|
| 557 | AGAUGGCU G AGGACAAG | 6895 | CUUGUCCU GGAGGAAACUCC CU UCAAGGACAUCGUCCGGG AGCCAUCU | 7316 |
| 559 | AUGGCUGA G GACAAGGC | 6896 | GCCUUGUC GGAGGAAACUCC CU UCAAGGACAUCGUCCGGG UCAGCCAU | 7317 |
| 560 | UGGCUGAG G ACAAGGCC | 6897 | GGCCUUGU GGAGGAAACUCC CU UCAAGGACAUCGUCCGGG CUCAGCCA | 7318 |
| 565 | GAGGACAA G CCCUCUCU | 6898 | ACAGAGGC GGAGGAAACUCC CU UCAAGGACAUCGUCCGGG UUGUCCUC | 7319 |
| 566 | AGGACAAG G CCUCUCUC | 5826 | CACAGAGG GGAGGAAACUCC CU UCAAGGACAUCGUCCGGG CUUGUCCU | 7320 |
| 572 | AGGCCUCU G UGAAACCC | 5827 | GGCUUUCA GGAGGAAACUCC CU UCAAGGACAUCGUCCGGG AGAGGCCU | 7321 |
| 574 | GCCUCUGU G AAACCCA | 6899 | UGGGCUUU GGAGGAAACUCC CU UCAAGGACAUCGUCCGGG ACAGAGGC | 7322 |
| 578 | CUGUGAAA G CCCACCUC | 5828 | CACCUGGG GGAGGAAACUCC CU UCAAGGACAUCGUCCGGG UUUCACAG | 7323 |
| 583 | AAAGCCCA G CUCACCUC | 6900 | GACGUCAC GGAGGAAACUCC CU UCAAGGACAUCGUCCGGG UGGGCUUU | 7324 |
| 584 | AAGCCCAG G UCACCUCC | 5829 | GGACGUCA GGAGGAAACUCC CU UCAAGGACAUCGUCCGGG CUGGGCUU | 7325 |
| 586 | GCCCAGGU G ACCUCCUU | 6901 | AAGGACGU GGAGGAAACUCC CU UCAAGGACAUCGUCCGGG ACCUGGGC | 7326 |
| 589 | CAGGUGAC G UCCUUCCU | 5830 | AGCAAGGA GGAGGAAACUCC CU UCAAGGACAUCGUCCGGG GUCACCUG | 7327 |
| 595 | ACGUCCUU G CUCCCGCA | 5831 | UCCCCGAG GGAGGAAACUCC CU UCAAGGACAUCGUCCGGG AAGGACGU | 7328 |
| 599 | CCUUGCUC G CCCACCUC | 6902 | CAGCUCCC GGAGGAAACUCC CU UCAAGGACAUCGUCCGGG GAGCAAGG | 7329 |
| 600 | CUUGCUCG G CCACCGCC | 6903 | GCAGCUCC GGAGGAAACUCC CU UCAAGGACAUCGUCCGGG CGAGCAAG | 7330 |
| 601 | UUGCUCGG G CACCUCCA | 6904 | UGCAGCUC GGAGGAAACUCC CU UCAAGGACAUCGUCCGGG CCGAGCAA | 7331 |
| 602 | UGCUCGGG G ACCUCCAC | 6905 | CUGCAGCU GGAGGAAACUCC CU UCAAGGACAUCGUCCGGG CCCGAGCA | 7332 |
| 604 | CUCGGGGA G CUCCACCA | 5832 | UCCUGCAG GGAGGAAACUCC CU UCAAGGACAUCGUCCGGG UCCCCGAG | 7333 |
| 607 | GGGGAGCU G CACCACAC | 5833 | CUCUCCUG GGAGGAAACUCC CU UCAAGGACAUCGUCCGGG AGCUCCCC | 7334 |
| 610 | GAGCUGCA G CACACCCA | 6906 | UGGCUCUC GGAGGAAACUCC CU UCAAGGACAUCGUCCGGG UGCAGCUC | 7335 |
| 611 | AGCUGCAG G ACACCCAC | 6907 | CUGGCUCU GGAGGAAACUCC CU UCAAGGACAUCGUCCGGG CUGCAGCU | 7336 |
| 613 | CUGCAGGA G AGCCAGAG | 6908 | CUCUGGCU GGAGGAAACUCC CU UCAAGGACAUCGUCCGGG UCCUGCAG | 7337 |
| 615 | GCAGGAGA G CCAGAGUC | 5834 | GACUCUGG GGAGGAAACUCC CU UCAAGGACAUCGUCCGGG UCUCCUGC | 7338 |
| 619 | GAGAGCCA G AGUCGCUU | 6909 | AAGCGACU GGAGGAAACUCC CU UCAAGGACAUCGUCCGGG UGGCUCUC | 7339 |
| 621 | GAGCCAGA G UCGCUUGG | 5835 | CCAAGCGA GGAGGAAACUCC CU UCAAGGACAUCGUCCGGG UCUGGCUC | 7340 |
| 624 | CCAGAGUC G CUUGGAGG | 5836 | CCUCCAAG GGAGGAAACUCC CU UCAAGGACAUCGUCCGGG GACUCUGG | 7341 |
| 628 | ACUCGCUU G CAGGCUGC | 6910 | GCAGCCUC GGAGGAAACUCC CU UCAAGGACAUCGUCCGGG AAGCGACU | 7342 |
| 629 | CUCGCUUG G AGGCUGCC | 6911 | GGCAGCCU GGAGGAAACUCC CU UCAAGGACAUCGUCCGGG CAAGCGAC | 7343 |
| 631 | CGCUUGGA G GCUGCCU | 6912 | GUGGCAGC GGAGGAAACUCC CU UCAAGGACAUCGUCCGGG UCCAAGCG | 7344 |
| 632 | GCUUGGAC G CUGCCACU | 5837 | AGUGGCAC GGAGGAAACUCC CU UCAAGGACAUCGUCCGGG CUCCAAGC | 7345 |
| 635 | UGGAGGCU G CCACUAAG | 5838 | CUUAGUGG GGAGGAAACUCC CU UCAAGGACAUCGUCCGGG AGCCUCCA | 7346 |
| 643 | CCCACUAA G GAAUGCCA | 6913 | UGGCAUUC GGAGGAAACUCC CU UCAAGGACAUCGUCCGGG UUAGUGGC | 7347 |
| 644 | CCACUAAG G AAUGCCAC | 6914 | CUGGCAUU GGAGGAAACUCC CU UCAAGGACAUCGUCCGGG CUUAGUGG | 7348 |
| 648 | UAAGGAAU G CCAGGCUC | 5839 | GAGCCUCG GGAGGAAACUCC CU UCAAGGACAUCGUCCGGG AUUCCUUA | 7349 |
| 652 | CAAUGCCA G CCUCUCCA | 6915 | UCCACAGC GGAGGAAACUCC CU UCAAGGACAUCGUCCGGG UGGCAUUC | 7350 |
| 653 | AAUGCCAG G CUCUGGAG | 5840 | CUCCAGAG GGAGGAAACUCC CU UCAAGGACAUCGUCCGGG CUGGCAUU | 7351 |
| 658 | CACGCUCU G CAGGGUCG | 6916 | CGACCCUG GGAGGAAACUCC CU UCAAGGACAUCGUCCGGG AGAGCCUG | 7352 |
| 659 | ACGCUCUG G AGGCUCGC | 6917 | CCCACCCU GGAGGAAACUCC CU UCAAGGACAUCGUCCGGG CAGAGCCU | 7353 |
| 661 | GCUCUGGA G CGUCGGGC | 6918 | GCCCGACC GGAGGAAACUCC CU UCAAGGACAUCGUCCGGG UCCAGAGC | 7354 |
| 662 | CUCUGGAG G UCGCGCC | 6919 | GGCCCAC GGAGGAAACUCC CU UCAAGGACAUCGUCCGGG CUCCAGAG | 7355 |
| 663 | UCUGGAGG G UCGCGGCC | 5841 | GGGCCCGA GGAGGAAACUCC CU UCAAGGACAUCGUCCGGG CCUCCAGA | 7356 |
| 666 | GGAGGCUC G GGCCCGGG | 6920 | CCCGGGCC GGAGGAAACUCC CU UCAAGGACAUCGUCCGGG GACCCUCC | 7357 |
| 667 | GACGUCG G CCCGGGC | 6921 | GCCCGGGC GGAGGAAACUCC CU UCAAGGACAUCGUCCGGG CGACCCUC | 7358 |
| 668 | ACGGUCGG G CCCGCGCG | 5842 | CGCCCGGG GGAGGAAACUCC CU UCAAGGACAUCGUCCGGG CCGACCCU | 7359 |
| 672 | UCGGGCCC G GGCCCCA | 6922 | UGGCCGCC GGAGGAAACUCC CU UCAAGGACAUCGUCCGGG GGGCCCGA | 7360 |
| 673 | CGCCCCCG G CGCCCAG | 6923 | CUGGCCGC GGAGGAAACUCC CU UCAAGGACAUCGUCCGGG CGGGCCCG | 7361 |
| 674 | GGGCCCGG G CCCCAGC | 5843 | GCUGGCCG GGAGGAAACUCC CU UCAAGGACAUCGUCCGGG CCGGGCCC | 7362 |
| 676 | GCCCGGGC G CCAGCCA | 6924 | UCGCUGGC GGAGGAAACUCC CU UCAAGGACAUCGUCCGGG GCCCGGGC | 7363 |
| 677 | CCCGGGCG G CCAGCCAC | 5844 | CUCGCUGG GGAGGAAACUCC CU UCAAGGACAUCGUCCGGG CGCCCGGG | 7364 |
| 681 | GGCGGCCA G CGAGCAGG | 5845 | CCUGCUCG GGAGGAAACUCC CU UCAAGGACAUCGUCCGGG UGGCCGCC | 7365 |
| 683 | CGGCCAGC G AGCAGGCG | 6925 | CGCCUCCU GGAGGAAACUCC CU UCAAGGACAUCGUCCGGG GCUGGCCG | 7366 |
| 685 | GCCAGCGA G CAGGCGCG | 5846 | CGCGCCUG GGAGGAAACUCC CU UCAAGGACAUCGUCCGGG UCGCUGGC | 7367 |
| 688 | AGCGAGCA G GCGCGGCA | 6926 | UGCCGCGC GGAGGAAACUCC CU UCAAGGACAUCGUCCGGG UGCUCGCU | 7368 |
| 689 | GCGAGCAG G CGCGGCAG | 5847 | CUGCCGCG GGAGGAAACUCC CU UCAAGGACAUCGUCCGGG CUGCUCGC | 7369 |
| 691 | GAGCAGGC G CGGCAGCU | 5848 | AGCUGCCG GGAGGAAACUCC CU UCAAGGACAUCGUCCGGG GCGUCCUC | 7370 |
| 693 | GCAGGCGC G CAGCUGG | 6927 | CCAGCUGC GGAGGAAACUCC CU UCAAGGACAUCGUCCGGG CGCGCUGC | 7371 |
| 694 | CAGGCGCG G CAGCUGGA | 5849 | UCCAGCUG GGAGGAAACUCC CU UCAAGGACAUCGUCCGGG CGCGCCUG | 7372 |
| 697 | GCGCGGCA G CUGGAGAG | 5850 | CUCUCCAG GGAGGAAACUCC CU UCAAGGACAUCGUCCGGG UGCCGCGC | 7373 |
| 700 | CGGCAGCU G GAGAGUGA | 6928 | UCACUCUC GGAGGAAACUCC CU UCAAGGACAUCGUCCGGG AGCUGCCG | 7374 |
| 701 | GGCAGCUG G AGAGUGAG | 6929 | CUCACUCU GGAGGAAACUCC CU UCAAGGACAUCGUCCGGG CAGCUGCC | 7375 |
| 703 | CAGCUGGA G AGUGAGCG | 6930 | CGCUCACU GGAGGAAACUCC CU UCAAGGACAUCGUCCGGG UCCAGCUC | 7376 |
| 705 | GCUGGAGA G UGAGCGCG | 5851 | CGCGCUCA GGAGGAAACUCC CU UCAAGGACAUCGUCCGGG UCUCCAGC | 7377 |
| 707 | UGGAGAGU G AGCGCGAG | 6931 | CUCGCGCU GGAGGAAACUCC CU UCAAGGACAUCGUCCGGG ACUCUCCA | 7378 |
| 709 | GAGAGUGA G CGCGAGGC | 5852 | GCCUCGCG GGAGGAAACUCC CU UCAAGGACAUCGUCCGGG UCACUCUC | 7379 |
| 711 | GAGUGAGC G CGAGGCGC | 5853 | GCGCCUCG GGAGGAAACUCC CU UCAAGGACAUCGUCCGGG GCUCACUC | 7380 |
| 713 | GUGAGCGC G AGGCUG | 6932 | CAGCGCCU GGAGGAAACUCC CU UCAAGGACAUCGUCCGGG GCGCACAC | 7381 |
| 715 | GAGCGCGA G GCGCUGCA | 6933 | UGCAGCGC GGAGGAAACUCC CU UCAAGGACAUCGUCCGGG UCGCGCUC | 7382 |
| 716 | AGCGCGAG G CGCUGCAG | 5854 | CUGCAGCG GGAGGAAACUCC CU UCAAGGACAUCGUCCGGG CUCGCGCU | 7383 |
| 718 | CGCGAGGC G CUGCAGCA | 5855 | UGCUGCAG GGAGGAAACUCC CU UCAAGGACAUCGUCCGGG GCCUCGCG | 7384 |
| 721 | GAGGCGCU G CAGCAGCA | 5856 | UGCUGCUG GGAGGAAACUCC CU UCAAGGACAUCGUCCGGG AGCGCCUC | 7385 |
| 724 | GCGCUGCA G CAGCAGCA | 5857 | UGCUGCUG GGAGGAAACUCC CU UCAAGGACAUCGUCCGGG UGCAGCGC | 7386 |
| 727 | CUGCAGCA G CAGCACAG | 5858 | CUGUGCUG GGAGGAAACUCC CU UCAAGGACAUCGUCCGGG UGGUGGAG | 7387 |
| 730 | CAGCAGCA G CACAGCGU | 5859 | ACGCUGUG GGAGGAAACUCC CU UCAAGGACAUCGUCCGGG UGCUGCUG | 7388 |
| 735 | GCAGCACA G CGUGCAGG | 5860 | CCUGCACG GGAGGAAACUCC CU UCAAGGACAUCGUCCGGG UGUGCUGC | 7389 |
| 737 | AGCACAGC G UGCAGGUG | 5861 | CACCUGCA GGAGGAAACUCC CU UCAAGGACAUCGUCCGGG GCUGUGCU | 7390 |

TABLE VII-continued

Human IKK-gamma Amberzyme and Substrate Sequence

| Pos | Substrate | Seq ID | Amberzyme | Seq ID |
|-----|-----------|--------|-----------|--------|
| 739 | CACAGCGU G CAGGUGGA | 5862 | UCCACCUG GGAGGAAACUCC CU UCAAGGACAUCGUCCGGG ACGCUGUG | 7391 |
| 742 | AGCGUGCA G GUGGACCA | 6934 | UGGUCCAC GGAGGAAACUCC CU UCAAGGACAUCGUCCGGG UGCACGCU | 7392 |
| 743 | GCGUGCAG G UGGACCAG | 5863 | CUGGUCCA GGAGGAAACUCC CU UCAAGGACAUCGUCCGGG CUGCACGC | 7393 |
| 745 | GUGCAGGU G GACCAGCU | 6935 | AGCUGGUC GGAGGAAACUCC CU UCAAGGACAUCGUCCGGG ACCUGCAC | 7394 |
| 746 | UGCAGGUG G ACCAGCUG | 6936 | CAGCUGGU GGAGGAAACUCC CU UCAAGGACAUCGUCCGGG CACCUGCA | 7395 |
| 751 | GUGGACCA G CUGCGCAU | 5864 | AUGCGCAG GGAGGAAACUCC CU UCAAGGACAUCGUCCGGG UGGUCCAC | 7396 |
| 754 | GACCAGCU G CGCAUGCA | 5865 | UGCAUGCG GGAGGAAACUCC CU UCAAGGACAUCGUCCGGG AGCUGGUC | 7397 |
| 756 | CCAGCUGC G CAUGCAGG | 5866 | CCUGCAUG GGAGGAAACUCC CU UCAAGGACAUCGUCCGGG GCAGCUGG | 7398 |
| 760 | CUGCGCAU G CAGGGCCA | 5867 | UGGCCCUG GGAGGAAACUCC CU UCAAGGACAUCGUCCGGG AUGCGCAG | 7399 |
| 763 | CGCAUGCA G GGCCAGAG | 6937 | CUCUGGCC GGAGGAAACUCC CU UCAAGGACAUCGUCCGGG UGCAUGCG | 7400 |
| 764 | GCAUGCAG G GCCAGAGC | 6938 | GCUCUGGC GGAGGAAACUCC CU UCAAGGACAUCGUCCGGG CUGCAUGC | 7401 |
| 765 | CAUGCAGG G CCAGAGCG | 5868 | CGCUCUGG GGAGGAAACUCC CU UCAAGGACAUCGUCCGGG CCUGCAUG | 7402 |
| 769 | CAGGGCCA G AGCGUGGA | 6939 | UCCACGCU GGAGGAAACUCC CU UCAAGGACAUCGUCCGGG UGGCCCUG | 7403 |
| 771 | GGGCCAGA G CGUGGAGG | 5869 | CCUCCACG GGAGGAAACUCC CU UCAAGGACAUCGUCCGGG UCUGGCCC | 7404 |
| 773 | GCCAGAGC G UGGAGGCC | 5870 | GGCCUCCA GGAGGAAACUCC CU UCAAGGACAUCGUCCGGG GCUCUGGC | 7405 |
| 775 | CAGAGCGU G GAGGCCGC | 6940 | GCGGCCUC GGAGGAAACUCC CU UCAAGGACAUCGUCCGGG ACGCUCUG | 7406 |
| 776 | AGAGCGUG G AGGCCGCG | 6941 | CGCGGCCU GGAGGAAACUCC CU UCAAGGACAUCGUCCGGG CACGCUCU | 7407 |
| 778 | AGCGUGGA G GCCGCGCU | 6942 | AGCGCGGC GGAGGAAACUCC CU UCAAGGACAUCGUCCGGG UCCACGCU | 7408 |
| 779 | GCGUGGAG G CCGCGCUC | 5871 | GAGCGCGG GGAGGAAACUCC CU UCAAGGACAUCGUCCGGG CUCCACGC | 7409 |
| 782 | UGGAGGCC G CGCUCCGC | 5872 | GCGGAGCG GGAGGAAACUCC CU UCAAGGACAUCGUCCGGG GGCCUCCA | 7410 |
| 784 | GAGGCCGC G CUCCGCAU | 5873 | AUGCGGAG GGAGGAAACUCC CU UCAAGGACAUCGUCCGGG GCGGCCUC | 7411 |
| 789 | CGCGCUCC G CAUGGAGC | 5874 | GCUCCAUG GGAGGAAACUCC CU UCAAGGACAUCGUCCGGG GGAGCGCG | 7412 |
| 793 | CUCCGCAU G GAGCGCCA | 6943 | UGGCGCUC GGAGGAAACUCC CU UCAAGGACAUCGUCCGGG AUGCGGAG | 7413 |
| 794 | UCCGCAUG G AGCGCCAG | 6944 | CUGGCGCU GGAGGAAACUCC CU UCAAGGACAUCGUCCGGG CAUGCGGA | 7414 |
| 796 | CGCAUGGA G CGCCAGCG | 5875 | GCCUGGCG GGAGGAAACUCC CU UCAAGGACAUCGUCCGGG UCCAUGCG | 7415 |
| 798 | CAUGGAGC G CCAGGCCG | 5876 | CGGCCUGG GGAGGAAACUCC CU UCAAGGACAUCGUCCGGG GCUCCAUG | 7416 |
| 802 | GAGCGCCA G GCCGCCUC | 6945 | GAGGCGGC GGAGGAAACUCC CU UCAAGGACAUCGUCCGGG UGGCGCUC | 7417 |
| 803 | AGCGCCAG G CCGCCUCG | 5877 | CGAGGCGG GGAGGAAACUCC CU UCAAGGACAUCGUCCGGG CUGGCGCU | 7418 |
| 806 | GCCAGGCC G CCUCGGAG | 5878 | CUCCGAGG GGAGGAAACUCC CU UCAAGGACAUCGUCCGGG GGCCUGGC | 7419 |
| 811 | GCCGCCUC G GAGGAGAA | 6946 | UUCUCCUC GGAGGAAACUCC CU UCAAGGACAUCGUCCGGG GAGGCGGC | 7420 |
| 812 | CCGCCUCG G AGGAGAAG | 6947 | CUUCUCCU GGAGGAAACUCC CU UCAAGGACAUCGUCCGGG CGAGGCGG | 7421 |
| 814 | GCCUCGGA G GAGAAGAG | 6948 | CUCUUCUC GGAGGAAACUCC CU UCAAGGACAUCGUCCGGG UCCGAGGC | 7422 |
| 815 | CCUCGGAG G AGAAGAGG | 6949 | CCUCUUCU GGAGGAAACUCC CU UCAAGGACAUCGUCCGGG CUCCGAGG | 7423 |
| 817 | UCGGAGGA G AAGAGGAA | 6950 | UUCCUCUU GGAGGAAACUCC CU UCAAGGACAUCGUCCGGG UCCUCCGA | 7424 |
| 820 | GAGGAGAA G AGGAAGCU | 6951 | AGCUUCCU GGAGGAAACUCC CU UCAAGGACAUCGUCCGGG UUCUCCUC | 7425 |
| 822 | GGAGAAGA G GAAGCUGG | 6952 | CCAGCUUC GGAGGAAACUCC CU UCAAGGACAUCGUCCGGG UCUUCUCC | 7426 |
| 823 | GAGAAGAG G AAGCUGGC | 6953 | GCCAGCUU GGAGGAAACUCC CU UCAAGGACAUCGUCCGGG CUCUUCUC | 7427 |
| 826 | AAGAGGAA G CUGGCCCA | 5879 | UGGGCCAG GGAGGAAACUCC CU UCAAGGACAUCGUCCGGG UUCCUCUU | 7428 |
| 829 | AGGAAGCU G GCCCAGUU | 6954 | AACUGGGC GGAGGAAACUCC CU UCAAGGACAUCGUCCGGG AGCUUCCU | 7429 |
| 830 | GGAAGCUG G CCCAGUUG | 5880 | CAACUGGG GGAGGAAACUCC CU UCAAGGACAUCGUCCGGG CAGCUUCC | 7430 |
| 835 | CUGGCCCA G UUGCAGGU | 5881 | ACCUGCAA GGAGGAAACUCC CU UCAAGGACAUCGUCCGGG UGGGCCAG | 7431 |
| 838 | GCCCAGUU G CAGGUGGC | 5882 | GCCACCUG GGAGGAAACUCC CU UCAAGGACAUCGUCCGGG AACUGGGC | 7432 |
| 841 | CAGUUGCA G GUGGCCUA | 6955 | UAGGCCAC GGAGGAAACUCC CU UCAAGGACAUCGUCCGGG UGCAACUG | 7433 |
| 842 | AGUUGCAG G UGGCCUAU | 5883 | AUAGGCCA GGAGGAAACUCC CU UCAAGGACAUCGUCCGGG CUGCAACU | 7434 |
| 844 | UUGCAGGU G GCCUAUCA | 6956 | UGAUAGGC GGAGGAAACUCC CU UCAAGGACAUCGUCCGGG ACCUGCAA | 7435 |
| 845 | UGCAGGUG G CCUAUCAC | 5884 | GUGAUAGG GGAGGAAACUCC CU UCAAGGACAUCGUCCGGG CACCUGCA | 7436 |
| 856 | UAUCACCA G CUCUUCCA | 5885 | UGGAAGAG GGAGGAAACUCC CU UCAAGGACAUCGUCCGGG UGGUGAUA | 7437 |
| 866 | UCUUCCAA G AAUACGAC | 6957 | GUCGUAUU GGAGGAAACUCC CU UCAAGGACAUCGUCCGGG UUGGAAGA | 7438 |
| 872 | AAGAAUAC G ACAACCAC | 6958 | GUGGUUGU GGAGGAAACUCC CU UCAAGGACAUCGUCCGGG GUAUUCUU | 7439 |
| 886 | CACAUCAA G AGCAGCGU | 6959 | ACGCUGCU GGAGGAAACUCC CU UCAAGGACAUCGUCCGGG UUGAUGUG | 7440 |
| 888 | CAUCAAGA G CAGCGUGG | 5886 | CCACGCUG GGAGGAAACUCC CU UCAAGGACAUCGUCCGGG UCUUGAUG | 7441 |
| 891 | CAAGAGCA G CGUGGUGG | 5887 | CCACCACG GGAGGAAACUCC CU UCAAGGACAUCGUCCGGG UGCUCUUG | 7442 |
| 893 | AGAGCAGC G UGGUGGGC | 5888 | GCCCACCA GGAGGAAACUCC CU UCAAGGACAUCGUCCGGG GCUGCUCU | 7443 |
| 895 | AGCAGCGU G GUGGGCAG | 6960 | CUGCCCAC GGAGGAAACUCC CU UCAAGGACAUCGUCCGGG ACGCUGCU | 7444 |
| 896 | GCAGCGUG G UGGGCAGU | 5889 | ACUAGCCA GGAGGAAACUCC CU UCAAGGACAUCGUCCGGG CACGCUGC | 7445 |
| 898 | AGCGUGGU G GCAGUGA | 6961 | UCACUGCC GGAGGAAACUCC CU UCAAGGACAUCGUCCGGG ACCACGCU | 7446 |
| 899 | GCGUGGUG G GCAGUGAG | 5962 | CUCACUGC GGAGGAAACUCC CU UCAAGGACAUCGUCCGGG CACCACGC | 7447 |
| 900 | CGUGGUGG G CAGUGAGC | 5890 | GCUCACUG GGAGGAAACUCC CU UCAAGGACAUCGUCCGGG CCACCACG | 7448 |
| 903 | GGUGGGCA G UGAGCGGA | 5891 | UCCGCUCA GGAGGAAACUCC CU UCAAGGACAUCGUCCGGG UGCCCACC | 7449 |
| 905 | UGGGCAGU G AGCGGAAG | 6963 | CUUCCGCU GGAGGAAACUCC CU UCAAGGACAUCGUCCGGG ACUGCCCA | 7450 |
| 907 | GGCAGUGA G CGGAAGCG | 5892 | CGCUUCCG GGAGGAAACUCC CU UCAAGGACAUCGUCCGGG UCACUGCC | 7451 |
| 909 | CAGUGAGC G GAAGCAG | 6964 | CUCGCUUC GGAGGAAACUCC CU UCAAGGACAUCGUCCGGG GCUCACUG | 7452 |
| 910 | AGUGAGCG G AAGCGAGG | 6965 | CCUCGCUU GGAGGAAACUCC CU UCAAGGACAUCGUCCGGG CGCUCACU | 7453 |
| 913 | GAGCGGAA G CGAGGAAU | 5893 | AUUCCUCG GGAGGAAACUCC CU UCAAGGACAUCGUCCGGG UUCCGCUC | 7454 |
| 915 | GCGGAAGC G AGGAAUGC | 6966 | GCAUUCCU GGAGGAAACUCC CU UCAAGGACAUCGUCCGGG GCUUCCGC | 7455 |
| 917 | GGAAGCGA G GAAUGCAG | 6967 | CUGCAUUC GGAGGAAACUCC CU UCAAGGACAUCGUCCGGG UCGCUUCC | 7456 |
| 918 | GAAGCGAG G AAUGCAGC | 6968 | GCUGCAUU GGAGGAAACUCC CU UCAAGGACAUCGUCCGGG CUCGCUUC | 7457 |
| 922 | CGAGGAAU G CAGCUGGA | 5894 | UCCAGCUG GGAGGAAACUCC CU UCAAGGACAUCGUCCGGG AUUCCUCG | 7458 |
| 925 | GGAAUGCA G CUGGAAGA | 5895 | UCUUCCAG GGAGGAAACUCC CU UCAAGGACAUCGUCCGGG UGCAUUCC | 7459 |
| 928 | AUGCAGCU G GAAGAUCU | 6969 | ACAUCUUC GGAGGAAACUCC CU UCAAGGACAUCGUCCGGG AGCUGCAU | 7460 |
| 929 | UGCAGCUG G AAGAUCUC | 6970 | GAGAUCUU GGAGGAAACUCC CU UCAAGGACAUCGUCCGGG CAGCUGCA | 7461 |
| 932 | AGCUGGAA G AUCUCAAA | 6971 | UUUGAGAU GGAGGAAACUCC CU UCAAGGACAUCGUCCGGG UUCCAGCU | 7462 |
| 943 | CUCAAACA G CAGCUCCA | 5896 | UGGAGCUG GGAGGAAACUCC CU UCAAGGACAUCGUCCGGG UGUUUGAG | 7463 |
| 946 | AAACAGCA G CUCCAGCA | 5897 | UCCUGGAG GGAGGAAACUCC CU UCAAGGACAUCGUCCGGG UGCUGUUU | 7464 |
| 952 | CAGCUCCA G CAGGCCGA | 5898 | UCGGCCUG GGAGGAAACUCC CU UCAAGGACAUCGUCCGGG UGGAGCUG | 7465 |

TABLE VII-continued

Human IKK-gamma Amberzyme and Substrate Sequence

| Pos | Substrate | Seq ID | Amberzyme | Seq ID |
|---|---|---|---|---|
| 955 | CUCCAGCA G CCCGAGGA | 6972 | UCCUCGGC GGAGGAAACUCC CU UCAAGGACAUCGUCCGGG UGCUGGAG | 7466 |
| 956 | UCCAGCAG G CCGAGGAG | 5899 | CUCCUCGG GGAGGAAACUCC CU UCAAGGACAUCGUCCGGG CUGCUGGA | 7467 |
| 959 | AGCAGGCC G AGGAGGCC | 6973 | GGCCUCCU GGAGGAAACUCC CU UCAAGGACAUCGUCCGGG GGCCUCCU | 7468 |
| 961 | CAGGCCGA G GAGGCCCU | 6974 | AGGGCCUC GGAGGAAACUCC CU UCAAGGACAUCGUCCGGG UCGGCCUC | 7469 |
| 962 | AGGCCGAG G AGGCCCUG | 6975 | CAGGGCCU GGAGGAAACUCC CU UCAAGGACAUCGUCCGGG CUCGGCCU | 7470 |
| 964 | GCCGAGGA G GCCCUGGU | 6976 | ACCAGGGC GGAGGAAACUCC CU UCAAGGACAUCGUCCGGG UCCUCGGC | 7471 |
| 965 | CCGAGGAG G CCCUGGUG | 5900 | CACCAGGG GGAGGAAACUCC CU UCAAGGACAUCGUCCGGG CUCCUCGG | 7472 |
| 970 | GAGGCCCU G GUGGCCAA | 6977 | UUGGCCAC GGAGGAAACUCC CU UCAAGGACAUCGUCCGGG AGGGCCUC | 7473 |
| 971 | AGGCCCUG G UGGCCAAA | 5901 | UUUGGCCA GGAGGAAACUCC CU UCAAGGACAUCGUCCGGG CAGGGCCU | 7474 |
| 973 | GCCCUGGU G GCCAAACA | 6978 | UGUUUGGC GGAGGAAACUCC CU UCAAGGACAUCGUCCGGG ACCAGGGC | 7475 |
| 974 | CCCUGGUC C CAAACAG | 5902 | CUGUUUGG GGAGGAAACUCC CU UCAAGGACAUCGUCCGGG CACCAGGG | 7476 |
| 982 | GCCAAACA G GAGGUGAU | 6979 | AUCACCUC GGAGGAAACUCC CU UCAAGGACAUCGUCCGGG UGUUUGGC | 7477 |
| 983 | CCAAACAG G AGGUGAUC | 6980 | GAUCACCU GGAGGAAACUCC CU UCAAGGACAUCGUCCGGG CUGUUUGG | 7478 |
| 985 | AAACAGGA G GUGAUCGA | 6981 | UCGAUCAC GGAGGAAACUCC CU UCAAGGACAUCGUCCGGG UCCUGUUU | 7479 |
| 986 | AACAGGAG G UGAUCGAU | 5903 | AUCGAUCA GGAGGAAACUCC CU UCAAGGACAUCGUCCGGG CUCCUGUU | 7480 |
| 988 | CAGGAGGU G AUCGAUAA | 6982 | UUAUCGAU GGAGGAAACUCC CU UCAAGGACAUCGUCCGGG ACCUCCUG | 7481 |
| 992 | AGGUGAUC G AUAAGCUG | 6983 | CAGCUUAU GGAGGAAACUCC CU UCAAGGACAUCGUCCGGG GAUCACCU | 7482 |
| 997 | AUCGAUAA G CUGAAGGA | 5904 | UCCUUCAG GGAGGAAACUCC CU UCAAGGACAUCGUCCGGG UUAUCGAU | 7483 |
| 1000 | GAUAAGCU G AAGGAGGA | 6984 | UCCUCCUU GGAGGAAACUCC CU UCAAGGACAUCGUCCGGG AGCUUAUC | 7484 |
| 1003 | AAGCUGAA G GAGGAGGC | 6985 | GCCUCCUC GGAGGAAACUCC CU UCAAGGACAUCGUCCGGG UUCAGCUU | 7485 |
| 1004 | AGCUGAAG G AGGAGGCC | 6986 | GGCCUCCU GGAGGAAACUCC CU UCAAGGACAUCGUCCGGG CUUCAGCU | 7486 |
| 1006 | CUGAAGGA G GAGGCCCA | 6987 | UCGGCCUC GGAGGAAACUCC CU UCAAGGACAUCGUCCGGG UCCUUCAG | 7487 |
| 1007 | UGAAGGAG G AGGCCGAG | 6988 | CUCGGCCU GGAGGAAACUCC CU UCAAGGACAUCGUCCGGG CUCCUUCA | 7488 |
| 1009 | AAGGAGGA G GCCGAGCA | 6989 | UGCUCGGC GGAGGAAACUCC CU UCAAGGACAUCGUCCGGG UCCUCCUU | 7489 |
| 1010 | AGGAGGAG G CCGAGCAG | 5905 | CUGCUCGG GGAGGAAACUCC CU UCAAGGACAUCGUCCGGG CUCCUCCU | 7490 |
| 1013 | AGGAGGCC G AGCAGCAC | 6990 | GUGCUGCU GGAGGAAACUCC CU UCAAGGACAUCGUCCGGG GGCCUCCU | 7491 |
| 1015 | GAGGCCGA G CAGCACAA | 5906 | UUGUGCUG GGAGGAAACUCC CU UCAAGGACAUCGUCCGGG UCGGCCUC | 7492 |
| 1018 | GCCGAGCA G CACAAGAU | 5907 | AUCUUGUG GGAGGAAACUCC CU UCAAGGACAUCGUCCGGG UGCUCGGC | 7493 |
| 1024 | CAGCACAA G AUUGUGAU | 6991 | AUCACAAU GGAGGAAACUCC CU UCAAGGACAUCGUCCGGG UUGUGCUG | 7494 |
| 1028 | ACAAGAUU G UGAUGGAG | 5908 | CUCCAUCA GGAGGAAACUCC CU UCAAGGACAUCGUCCGGG AAUCUUGU | 7495 |
| 1030 | AAGAUUGU G AUGGAGAC | 6992 | GUCUCCAU GGAGGAAACUCC CU UCAAGGACAUCGUCCGGG ACAAUCUU | 7496 |
| 1033 | AUUGUGAU G GAGACCGU | 6993 | ACGGUCUC GGAGGAAACUCC CU UCAAGGACAUCGUCCGGG AUCACAAU | 7497 |
| 1034 | UUGUGAUG G AGACCGUU | 6994 | AACGGUCU GGAGGAAACUCC CU UCAAGGACAUCGUCCGGG CAUCACAA | 7498 |
| 1036 | GUGAUGGA G ACCGUUCC | 6995 | GGAACGGU GGAGGAAACUCC CU UCAAGGACAUCGUCCGGG UCCAUCAC | 7499 |
| 1040 | UGGAGACC G UUCCGGUG | 5909 | CACCGGAA GGAGGAAACUCC CU UCAAGGACAUCGUCCGGG GGUCUCCA | 7500 |
| 1045 | ACCGUUCC G GUGCUGAA | 6996 | UUCAGCAC GGAGGAAACUCC CU UCAAGGACAUCGUCCGGG GGAACGGU | 7501 |
| 1046 | CCGUUCCG G UGCUGAAG | 5910 | CUUCAGCA GGAGGAAACUCC CU UCAAGGACAUCGUCCGGG CGGAACGG | 7502 |
| 1048 | GUUCCGGU G CUGAAGGC | 5911 | GCCUUCAG GGAGGAAACUCC CU UCAAGGACAUCGUCCGGG ACCGGAAC | 7503 |
| 1051 | CCGGUGCU G AAGGCCCA | 6997 | UGGGCCUU GGAGGAAACUCC CU UCAAGGACAUCGUCCGGG AGCACCGG | 7504 |
| 1054 | GUGCUGAA G GCCCAGGC | 6998 | GCCUGGGC GGAGGAAACUCC CU UCAAGGACAUCGUCCGGG UUCAGCAC | 7505 |
| 1055 | UGCUGAAG G CCCAGGCG | 5912 | CGCCUGGG GGAGGAAACUCC CU UCAAGGACAUCGUCCGGG CUUCAGCA | 7506 |
| 1060 | AAGGCCCA G GCGGAUAU | 6999 | AUAUCCGC GGAGGAAACUCC CU UCAAGGACAUCGUCCGGG UGGGCCUU | 7507 |
| 1061 | AGGCCCAG G CGGAUAUC | 5913 | GAUAUCCG GGAGGAAACUCC CU UCAAGGACAUCGUCCGGG CUGGGCCU | 7508 |
| 1063 | GCCCAGGC G GAUAUCUA | 7000 | UAGAUAUC GGAGGAAACUCC CU UCAAGGACAUCGUCCGGG GCCUGGGC | 7509 |
| 1064 | CCCAGGCG G AUAUCUAC | 7001 | GUAGAUAU GGAGGAAACUCC CU UCAAGGACAUCGUCCGGG CGCCUGGG | 7510 |
| 1075 | AUCUACAA G CGGACUUC | 7002 | AAGUCCGC GGAGGAAACUCC CU UCAAGGACAUCGUCCGGG UUGUAGAU | 7511 |
| 1076 | UCUACAAG G CGGACUUCA | 5914 | GAAGUCCG GGAGGAAACUCC CU UCAAGGACAUCGUCCGGG CUUGUAGA | 7512 |
| 1078 | UACAAGGC G GACUUCCA | 7003 | UGGAAGUC GGAGGAAACUCC CU UCAAGGACAUCGUCCGGG GCCUUGUA | 7513 |
| 1079 | ACAAGGCG G ACUUCCAG | 7004 | CUGGAAGU GGAGGAAACUCC CU UCAAGGACAUCGUCCGGG CGCCUUGU | 7514 |
| 1087 | GACUUCCA G CUGAGAGG | 7005 | CUCUCAGC GGAGGAAACUCC CU UCAAGGACAUCGUCCGGG UGGAAGUC | 7515 |
| 1088 | ACUUCCAG G CUGAGAGG | 5915 | CCUCUCAG GGAGGAAACUCC CU UCAAGGACAUCGUCCGGG CUGGAAGU | 7516 |
| 1091 | UCCAGGCU G AGAGGCAG | 7006 | CUGCCUCU GGAGGAAACUCC CU UCAAGGACAUCGUCCGGG AGCCUGGA | 7517 |
| 1093 | CAGGCUGA G AGGCAGGC | 7007 | GCCUGCCU GGAGGAAACUCC CU UCAAGGACAUCGUCCGGG UCAGCCUG | 7518 |
| 1095 | GGCUGAGA G GCAGGCCG | 7008 | GGGCCUGC GGAGGAAACUCC CU UCAAGGACAUCGUCCGGG UCUCAGCC | 7519 |
| 1096 | GCUGAGAG G CAGGCCCG | 5916 | CGGGCCUG GGAGGAAACUCC CU UCAAGGACAUCGUCCGGG CUCUCAGC | 7520 |
| 1099 | GAGAGGCA G GCCCGGGA | 7009 | UCCCGGGC GGAGGAAACUCC CU UCAAGGACAUCGUCCGGG UGCCUCUC | 7521 |
| 1100 | AGAGGCAG G CCCGGGAG | 5917 | CUCCCGGG GGAGGAAACUCC CU UCAAGGACAUCGUCCGGG CUGCCUCU | 7522 |
| 1104 | GCAGGCCC G GAGAAGC | 7010 | GCUUCUCC GGAGGAAACUCC CU UCAAGGACAUCGUCCGGG GGGCCUGC | 7523 |
| 1105 | CAGGCCCG G AGAAGCU | 7011 | AGCUUCUC GGAGGAAACUCC CU UCAAGGACAUCGUCCGGG CGGGCCUG | 7524 |
| 1106 | AGGCCCGG G AGAAGCUG | 7012 | CAGCUUCU GGAGGAAACUCC CU UCAAGGACAUCGUCCGGG CCGGGCCU | 7525 |
| 1108 | GCCCGGGA G AAGCUGGC | 7013 | GCCAGCUU GGAGGAAACUCC CU UCAAGGACAUCGUCCGGG UCCCGGGC | 7526 |
| 1111 | CGGGAGAA G CUGGCCGA | 5918 | UCGGCCAG GGAGGAAACUCC CU UCAAGGACAUCGUCCGGG UUCUCCCG | 7527 |
| 1114 | GAGAAGCU G GCCGAGAA | 7014 | UUCUCGGC GGAGGAAACUCC CU UCAAGGACAUCGUCCGGG AGCUUCUC | 7528 |
| 1115 | AGAAGCUG G CCGAGAAG | 5919 | CUUCUCGG GGAGGAAACUCC CU UCAAGGACAUCGUCCGGG CAGCUUCU | 7529 |
| 1118 | AGCUGGCC G AGAAGAAG | 7015 | CUUCUUCU GGAGGAAACUCC CU UCAAGGACAUCGUCCGGG GGCCAGCU | 7530 |
| 1120 | CUGGCCGA G AAGAAGGA | 7016 | UCCUUCUU GGAGGAAACUCC CU UCAAGGACAUCGUCCGGG UCGGCCAG | 7531 |
| 1123 | GCCGAGAA G AAGGAGCU | 7017 | AGCCUCCUU GGAGGAAACUCC CU UCAAGGACAUCGUCCGGG UUCUCGGC | 7532 |
| 1126 | GAGAAGAA G GAGCUCCU | 7018 | AGGAGCUC GGAGGAAACUCC CU UCAAGGACAUCGUCCGGG UUCUUCUC | 7533 |
| 1127 | AGAAGAAG G AGCUCCUG | 7019 | CAGGAGCU GGAGGAAACUCC CU UCAAGGACAUCGUCCGGG CUUCUUCU | 7534 |
| 1129 | AAGAAGGA G CUCCUGCA | 5920 | UGCAGGAG GGAGGAAACUCC CU UCAAGGACAUCGUCCGGG UCCUUCUU | 7535 |
| 1135 | GAGCUCCU G CAGGAGCA | 5921 | UGCUCCUG GGAGGAAACUCC CU UCAAGGACAUCGUCCGGG AGGAGCUC | 7536 |
| 1138 | CUCCUGCA G GAGCAGCU | 7020 | AGCUGCUC GGAGGAAACUCC CU UCAAGGACAUCGUCCGGG UGCAGGAG | 7537 |
| 1139 | UCCUGCAG G AGCAGCUG | 7021 | CAGCUGCU GGAGGAAACUCC CU UCAAGGACAUCGUCCGGG CUGCAGGA | 7538 |
| 1141 | CUGCAGGA G CAGCUGGA | 5922 | UCCAGCUG GGAGGAAACUCC CU UCAAGGACAUCGUCCGGG UCCUGCAG | 7539 |
| 1144 | CAGGAGCA G CUGGAGCA | 5923 | UGCUCCAG GGAGGAAACUCC CU UCAAGGACAUCGUCCGGG UGCUCCUG | 7540 |

TABLE VII-continued

Human IKK-gamma Amberzyme and Substrate Sequence

| Pos | Substrate | Seq ID | Amberzyme | Seq ID |
|---|---|---|---|---|
| 1147 | GACCAGCU G GAGCACCU | 7022 | ACCUCCUC GGAGGAAACUCC CU UCAAGGACAUCGUCCGGG ACCUCCUC | 7541 |
| 1148 | AGCAGCUG G AGCAGCUG | 7023 | CAGCUGCU GGAGGAAACUCC CU UCAAGGACAUCGUCCGGG CAGCUGCU | 7542 |
| 1150 | CACCUGGA G CACCUCCA | 5924 | UGCAGCUG GGAGGAAACUCC CU UCAAGGACAUCGUCCGGG UCCACCUG | 7543 |
| 1153 | CUGGAGCA G CUGCAGAG | 5925 | CUCUGCAG GGAGGAAACUCC CU UCAAGGACAUCGUCCGGG UGCUCCAG | 7544 |
| 1156 | GAGCAGCU G CAGAGGGA | 5926 | UCCCUCUG GGAGGAAACUCC CU UCAAGGACAUCGUCCGGG AGCUGCUC | 7545 |
| 1159 | CAGCUGCA G AGGGAGUA | 7024 | UACUCCCU GGAGGAAACUCC CU UCAAGGACAUCGUCCGGG UGCAGCUG | 7546 |
| 1161 | GCUGCAGA G GGAGUACA | 7025 | UGUACUCC GGAGGAAACUCC CU UCAAGGACAUCGUCCGGG UCUGCAGC | 7547 |
| 1162 | CUGCAGAG G GAGUACAG | 7026 | CUGUACUC GGAGGAAACUCC CU UCAAGGACAUCGUCCGGG CUCUCCAG | 7548 |
| 1163 | UGCAGAGG G AGUACAGC | 7027 | GCUGUACU GGAGGAAACUCC CU UCAAGGACAUCGUCCGGG CCUCUGCA | 7549 |
| 1165 | CAGAGGGA G UACAGCAA | 5927 | UUGCUGUA GGAGGAAACUCC CU UCAAGGACAUCGUCCGGG UCCCUCUG | 7550 |
| 1170 | GGAGUACA G CAAACUGA | 5928 | UCAGUUUG GGAGGAAACUCC CU UCAAGGACAUCGUCCGGG UGUACUCC | 7551 |
| 1177 | AGCAAACU G AAGGCCAG | 7028 | CUGGCCUU GGAGGAAACUCC CU UCAAGGACAUCGUCCGGG AGUUUGCU | 7552 |
| 1180 | AAACUGAA G GCCAGCUG | 7029 | CAGCUGGC GGAGGAAACUCC CU UCAAGGACAUCGUCCGGG UUCAGUUU | 7553 |
| 1181 | AACUGAAG G CCAGCUGU | 5929 | ACAGCUGG GGAGGAAACUCC CU UCAAGGACAUCGUCCGGG CUUCAGUU | 7554 |
| 1185 | GAAGGCCA G CUGUCAGG | 5930 | CCUGACAG GGAGGAAACUCC CU UCAAGGACAUCGUCCGGG UGGCCUUC | 7555 |
| 1188 | GGCCAGCU G UCAGGAGU | 5931 | ACUCCUGA GGAGGAAACUCC CU UCAAGGACAUCGUCCGGG AGCUGGCC | 7556 |
| 1192 | AGCUGUCA G GAGUCGGC | 7030 | GCCGACUC GGAGGAAACUCC CU UCAAGGACAUCGUCCGGG UGACAGCU | 7557 |
| 1193 | GCUGUCAG G AGUCGGCC | 7031 | GGCCGACU GGAGGAAACUCC CU UCAAGGACAUCGUCCGGG CUGACAGC | 7558 |
| 1195 | UGUCAGGA G UCGCCAG | 5932 | CUGGCCGA GGAGGAAACUCC CU UCAAGGACAUCGUCCGGG UCCUGACA | 7559 |
| 1198 | CAGGAGUC G GCCAGGAU | 7032 | AUCCUGGC GGAGGAAACUCC CU UCAAGGACAUCGUCCGGG GACUCCUG | 7560 |
| 1199 | AGGAGUCG G CCAGGAUC | 5933 | GAUCCUGG GGAGGAAACUCC CU UCAAGGACAUCGUCCGGG CGACUCCU | 7561 |
| 1203 | GUCGGCCA G GAUCGAGG | 7033 | CCUCGAUC GGAGGAAACUCC CU UCAAGGACAUCGUCCGGG UGGCCGAC | 7562 |
| 1204 | UCGGCCAG G AUCCAGGA | 7034 | UCCUCGAU GGAGGAAACUCC CU UCAAGGACAUCGUCCGGG CUGGCCGA | 7563 |
| 1208 | CCAGGAUC G AGGACAUC | 7035 | CAUGUCCU GGAGGAAACUCC CU UCAAGGACAUCGUCCGGG GAUCCUGC | 7564 |
| 1210 | AGGAUCGA G GACAUGAG | 7036 | CUCAUGUC GGAGGAAACUCC CU UCAAGGACAUCGUCCGGG UCGAUCCU | 7565 |
| 1211 | GGAUCGAG G ACAUGAGG | 7037 | CCUCAUGU GGAGGAAACUCC CU UCAAGGACAUCGUCCGGG CUCGAUCC | 7566 |
| 1216 | GAGGACAU G AGGAAGCG | 7038 | CGCUUCCU GGAGGAAACUCC CU UCAAGGACAUCGUCCGGG AUGUCCUC | 7567 |
| 1218 | GGACAUGA G GAAGCGGC | 7039 | GCCGCUUC GGAGGAAACUCC CU UCAAGGACAUCGUCCGGG UCAUGUCC | 7568 |
| 1219 | GACAUGAG G AAGCGGCA | 7040 | UGCCGCUU GGAGGAAACUCC CU UCAAGGACAUCGUCCGGG CUCAUGUC | 7569 |
| 1222 | AUGAGGAA G CGGCAUGU | 5934 | ACAUGCCG GGAGGAAACUCC CU UCAAGGACAUCGUCCGGG UUCCUCAU | 7570 |
| 1224 | GAGGAAGC G GCAUGUCG | 7041 | CGACAUGC GGAGGAAACUCC CU UCAAGGACAUCGUCCGGG GCUUCCUC | 7571 |
| 1225 | AGGAAGCG G CAUGUCGA | 5935 | UCGACAUG GGAGGAAACUCC CU UCAAGGACAUCGUCCGGG CGCUUCCU | 7572 |
| 1229 | AGCGGCAU G UCGAGGUC | 5936 | GACCUCGA GGAGGAAACUCC CU UCAAGGACAUCGUCCGGG AUGCCGCU | 7573 |
| 1232 | GCCAUGUC G AGGUCUCC | 7042 | GGAGACCU GGAGGAAACUCC CU UCAAGGACAUCGUCCGGG GACAUGCC | 7574 |
| 1234 | CAUGUCCA G GUCUCCCA | 7043 | UGGGAGAC GGAGGAAACUCC CU UCAAGGACAUCGUCCGGG UCGACAUG | 7575 |
| 1235 | AUGUCGAC G UCUCCCAG | 5937 | CUGGGAGA GGAGGAAACUCC CU UCAAGGACAUCGUCCGGG CUCGACAU | 7576 |
| 1243 | GUCUCCCA G GCCCCUU | 7044 | AAGGGGGC GGAGGAAACUCC CU UCAAGGACAUCGUCCGGG UGGGAGAC | 7577 |
| 1244 | UCUCCCAG G CCCCCUUG | 5938 | CAAGGGGG GGAGGAAACUCC CU UCAAGGACAUCGUCCGGG CUGGGAGA | 7578 |
| 1252 | GCCCCCUU G CCCCCCGC | 5939 | GCGGGGGG GGAGGAAACUCC CU UCAAGGACAUCGUCCGGG AAGGGGGC | 7579 |
| 1259 | UGCCCCCC G CCCCUGCC | 5940 | GGCAGGGG GGAGGAAACUCC CU UCAAGGACAUCGUCCGGG GGGGGGCA | 7580 |
| 1265 | CCCCCCU G CCUACCUC | 5941 | GAGGUAGG GGAGGAAACUCC CU UCAAGGACAUCGUCCGGG AGGGGCGG | 7581 |
| 1285 | UCUCCCCU G GCCCUGCC | 7045 | GGCAGGGC GGAGGAAACUCC CU UCAAGGACAUCGUCCGGG AGGGGAGA | 7582 |
| 1286 | CUCCCCUC G CCCUGCCC | 5942 | GGGCAGGG GGAGGAAACUCC CU UCAAGGACAUCGUCCGGG CAGGGGAG | 7583 |
| 1291 | CUGCCCCU G CCCAGCCA | 5943 | UGGCUGGG GGAGGAAACUCC CU UCAAGGACAUCGUCCGGG AGGGCCAG | 7584 |
| 1296 | CCUGCCCA G CCAGAGGA | 5944 | UCCUCUGG GGAGGAAACUCC CU UCAAGGACAUCGUCCGGG UGGGCAGG | 7585 |
| 1300 | CCCAGCCA G AGGAGGAG | 7046 | CUCCUCCU GGAGGAAACUCC CU UCAAGGACAUCGUCCGGG UGGCUGGG | 7586 |
| 1302 | CAGCCAGA G GAGGAGCC | 7047 | GGCUCCUC GGAGGAAACUCC CU UCAAGGACAUCGUCCGGG UCUGGCUG | 7587 |
| 1303 | AGCCAGAG G AGGAGCCC | 7048 | GGGCUCCU GGAGGAAACUCC CU UCAAGGACAUCGUCCGGG CUCUGGCU | 7588 |
| 1305 | CCAGAGGA G GAGCCCCC | 7049 | GGGGGCUC GGAGGAAACUCC CU UCAAGGACAUCGUCCGGG UCCUCUGG | 7589 |
| 1306 | CAGAGGAG G AGCCCCCC | 7050 | GGGGGGCU GGAGGAAACUCC CU UCAAGGACAUCGUCCGGG CUCCUCUG | 7590 |
| 1308 | GAGGAGGA G CCCCCCCG | 5945 | CGGGGGGG GGAGGAAACUCC CU UCAAGGACAUCGUCCGGG UCCUCCUC | 7591 |
| 1316 | GCCCCCCC G AGGAGCCA | 7051 | UGGCUCCU GGAGGAAACUCC CU UCAAGGACAUCGUCCGGG GGGGGGGC | 7592 |
| 1318 | CCCCCCGA G GAGCCACC | 7052 | GGUGGCUC GGAGGAAACUCC CU UCAAGGACAUCGUCCGGG UCGGGGGG | 7593 |
| 1319 | CCCCCGAG G AGCCACCU | 7053 | AGGUGGCU GGAGGAAACUCC CU UCAAGGACAUCGUCCGGG CUCGGGGG | 7594 |
| 1321 | CCCGAGGA G CCACCUGA | 5946 | UCAGGUGG GGAGGAAACUCC CU UCAAGGACAUCGUCCGGG UCCUCGGG | 7595 |
| 1328 | AGCCACCU G ACUUCUGC | 7054 | GCAGAAGU GGAGGAAACUCC CU UCAAGGACAUCGUCCGGG AGGUGGCU | 7596 |
| 1335 | UGACUUCU G CUGUCCCA | 5947 | UGGGACAG GGAGGAAACUCC CU UCAAGGACAUCGUCCGGG AGAAGUCA | 7597 |
| 1338 | CUUCUGCU G UCCCAAGU | 5948 | ACUUGGGA GGAGGAAACUCC CU UCAAGGACAUCGUCCGGG AGCAGAAG | 7598 |
| 1345 | UGUCCCAA G UGCAGUA | 5949 | UACUGGCA GGAGGAAACUCC CU UCAAGGACAUCGUCCGGG UUGGGACA | 7599 |
| 1347 | UCCCAAGU G CCAGUAUC | 5950 | GAUACUGG GGAGGAAACUCC CU UCAAGGACAUCGUCCGGG ACUUGGGA | 7600 |
| 1351 | AAGUGCCA G UAUCAGGC | 5951 | GCCUGAUA GGAGGAAACUCC CU UCAAGGACAUCGUCCGGG UGGCACUU | 7601 |
| 1357 | CAGUAUCA G GCCCCUGA | 7055 | UCAGGGGC GGAGGAAACUCC CU UCAAGGACAUCGUCCGGG UGAUACUG | 7602 |
| 1358 | AGUAUCAG G CCCCUGAU | 5952 | AUCAGGGG GGAGGAAACUCC CU UCAAGGACAUCGUCCGGG CUGAUACU | 7603 |
| 1364 | AGGCCCCU G AUAUGGAC | 7056 | GUCCAUAU GGAGGAAACUCC CU UCAAGGACAUCGUCCGGG AGGGGCCU | 7604 |
| 1369 | CCUGAUAU G GACACCCU | 7057 | AGGGUGUC GGAGGAAACUCC CU UCAAGGACAUCGUCCGGG AUAUCAGG | 7605 |
| 1370 | CUGAUAUG G ACACCCUG | 7058 | CAGGGUGU GGAGGAAACUCC CU UCAAGGACAUCGUCCGGG CAUAUCAG | 7606 |
| 1378 | GACACCCU G CAGAUACA | 5953 | UGUAUCUG GGAGGAAACUCC CU UCAAGGACAUCGUCCGGG AGGGUGUC | 7607 |
| 1381 | ACCCUGCA G AUACAUGU | 7059 | ACAUGUAU GGAGGAAACUCC CU UCAAGGACAUCGUCCGGG UGCAGGGU | 7608 |
| 1388 | AGAUACAU G UCAUGGAG | 5954 | CUCCAUGA GGAGGAAACUCC CU UCAAGGACAUCGUCCGGG AUGUAUCU | 7609 |
| 1393 | CAUGUCAU G GAGUGCAU | 7060 | AUGCACUC GGAGGAAACUCC CU UCAAGGACAUCGUCCGGG AUGACAUG | 7610 |
| 1394 | AUGUCAUG G AGUGCAUU | 7061 | AAUGCACU GGAGGAAACUCC CU UCAAGGACAUCGUCCGGG CAUGACAU | 7611 |
| 1396 | GUCAUGGA G UGCAUUGA | 5955 | UCAAUGCA GGAGGAAACUCC CU UCAAGGACAUCGUCCGGG UCCAUGAC | 7612 |
| 1398 | CAUGGAGU G CAUUGAGU | 5956 | ACUCAAUG GGAGGAAACUCC CU UCAAGGACAUCGUCCGGG ACUCCAUG | 7613 |
| 1403 | AGUGCAUU G AGUAGGGC | 7062 | GCCCUACU GGAGGAAACUCC CU UCAAGGACAUCGUCCGGG AAUGCACU | 7614 |
| 1405 | UGCAUUGA G UAGGGCCG | 5957 | CGGCCCUA GGAGGAAACUCC CU UCAAGGACAUCGUCCGGG UCAAUGCA | 7615 |

TABLE VII-continued

Human IKK-gamma Amberzyme and Substrate Sequence

| Pos | Substrate | Seq ID | Amberzyme | Seq ID |
|---|---|---|---|---|
| 1408 | AUUGAGUA G GGCCGGCC | 7063 | GGCCGGCC GGAGGAAACUCC CU UCAAGGACAUCGUCCGGG UACUCAAU | 7616 |
| 1409 | UUGAGUAG G GCCGGCCA | 7064 | UGGCCGGC GGAGGAAACUCC CU UCAAGGACAUCGUCCGGG CUACUCAA | 7617 |
| 1410 | UGAGUAGG G CCGGCCAG | 5958 | CUGGCCGG GGAGGAAACUCC CU UCAAGGACAUCGUCCGGG CCUACUCA | 7618 |
| 1413 | GUAGGGCC G GCCAGUGC | 7065 | GCACUGGC GGAGGAAACUCC CU UCAAGGACAUCGUCCGGG GGCCCUAC | 7619 |
| 1414 | UAGGGCCG G CCAGUGCA | 5959 | UGCACUGG GGAGGAAACUCC CU UCAAGGACAUCGUCCGGG CGGCCCUA | 7620 |
| 1418 | GCCGCCCA G UGCAAGGC | 5960 | GCCUUGCA GGAGGAAACUCC CU UCAAGGACAUCGUCCGGG UGGCCGGC | 7621 |
| 1420 | CGGCCAGU G CAAGGCCA | 5961 | UGGCCUUG GGAGGAAACUCC CU UCAAGGACAUCGUCCGGG ACUGGCCG | 7622 |
| 1424 | CAGUGCAA G GCCACUGC | 7066 | GCAGUGGC GGAGGAAACUCC CU UCAAGGACAUCGUCCGGG UUGCACUG | 7623 |
| 1425 | AGUGCAAG G CCACUGCC | 5962 | GGCAGUGG GGAGGAAACUCC CU UCAAGGACAUCGUCCGGG CUUGCACU | 7624 |
| 1431 | AGGCCACU G CCUGCCCG | 5963 | CGGGCAGG GGAGGAAACUCC CU UCAAGGACAUCGUCCGGG AGUGGCCU | 7625 |
| 1435 | CACUGCCU G CCCGAGGA | 5964 | UCCUCGGG GGAGGAAACUCC CU UCAAGGACAUCGUCCGGG AGGCAGUG | 7626 |
| 1439 | GCCUGCCC G AGGACGUG | 7067 | CACGUCCU GGAGGAAACUCC CU UCAAGGACAUCGUCCGGG GGGCAGGC | 7627 |
| 1441 | CUGCCCGA G GACGUGCC | 7068 | GGCACGUC GGAGGAAACUCC CU UCAAGGACAUCGUCCGGG UCGGGCAG | 7628 |
| 1442 | UGCCCGAG G ACGUGCCC | 7069 | GGGCACGU GGAGGAAACUCC CU UCAAGGACAUCGUCCGGG CUCGGGCA | 7629 |
| 1445 | CCGAGGAC G UGCCCGGG | 5965 | CCCGGGCA GGAGGAAACUCC CU UCAAGGACAUCGUCCGGG GUCCUCGG | 7630 |
| 1447 | GAGGACGU G CCCGGGAC | 5966 | GUCCCGGG GGAGGAAACUCC CU UCAAGGACAUCGUCCGGG ACGUCCUC | 7631 |
| 1451 | ACGUGCCC G GGACCGUG | 7070 | CACGGUCC GGAGGAAACUCC CU UCAAGGACAUCGUCCGGG GGGCACGU | 7632 |
| 1452 | CGUGCCCG G GACCGUGC | 7071 | GCACGGUC GGAGGAAACUCC CU UCAAGGACAUCGUCCGGG CGGGCACG | 7633 |
| 1453 | GUGCCCGG G ACCGUGCA | 7072 | UGCACGGU GGAGGAAACUCC CU UCAAGGACAUCGUCCGGG CCGGGCAC | 7634 |
| 1457 | CCGGGACC G UGCAGUCU | 5967 | AGACUGCA GGAGGAAACUCC CU UCAAGGACAUCGUCCGGG GGUCCCGG | 7635 |
| 1459 | GGGACCGU G CAGUCUGC | 5968 | GCAGACUG GGAGGAAACUCC CU UCAAGGACAUCGUCCGGG ACGGUCCC | 7636 |
| 1462 | ACCGUGCA G UCUGCGCU | 5969 | AGCGCAGA GGAGGAAACUCC CU UCAAGGACAUCGUCCGGG UGCACGGU | 7637 |
| 1466 | UGCAGUCU G CGCUUUCC | 5970 | GGAAAGCG GGAGGAAACUCC CU UCAAGGACAUCGUCCGGG AGACUGCA | 7638 |
| 1468 | CAGUCUGC G CUUUCCUC | 5971 | GAGGAAAG GGAGGAAACUCC CU UCAAGGACAUCGUCCGGG GCAGACUG | 7639 |
| 1481 | CCUCUCCG G CCUGCCUA | 5972 | UAGGCAGG GGAGGAAACUCC CU UCAAGGACAUCGUCCGGG GGGAGAGG | 7640 |
| 1485 | UCCGCCUG G CCUAGCCC | 5973 | GGGCUAGG GGAGGAAACUCC CU UCAAGGACAUCGUCCGGG AGGCGGGA | 7641 |
| 1490 | CCUGCCUA G CCCAGGAU | 5974 | AUCCUGGG GGAGGAAACUCC CU UCAAGGACAUCGUCCGGG UAGGCAGG | 7642 |
| 1495 | CUAGCCCA G GAUGAAGG | 7073 | CCUUCAUC GGAGGAAACUCC CU UCAAGGACAUCGUCCGGG UGGGCUAG | 7643 |
| 1496 | UAGCCCAG G AUGAAGGG | 7074 | CCCUUCAU GGAGGAAACUCC CU UCAAGGACAUCGUCCGGG CUGGGCUA | 7644 |
| 1499 | CCCAGGAU G AAGGGCUG | 7075 | CAGCCCUU GGAGGAAACUCC CU UCAAGGACAUCGUCCGGG AUCCUGGG | 7645 |
| 1502 | AGGAUGAA G GGCUGGGU | 7076 | ACCCAGCC GGAGGAAACUCC CU UCAAGGACAUCGUCCGGG UUCAUCCU | 7646 |
| 1503 | GGAUGAAG G GCUGGGUG | 7077 | CACCCAGC GGAGGAAACUCC CU UCAAGGACAUCGUCCGGG CUUCAUCC | 7647 |
| 1504 | GAUGAAGG G CUGGGUGG | 5975 | CCACCCAG GGAGGAAACUCC CU UCAAGGACAUCGUCCGGG CCUUCAUC | 7648 |
| 1507 | GAAGGGCU G GGUGGCCA | 7078 | UGGCCACC GGAGGAAACUCC CU UCAAGGACAUCGUCCGGG AGCCCUUC | 7649 |
| 1508 | AAGGGCUG G GUGGCCAC | 7079 | GUGGCCAC GGAGGAAACUCC CU UCAAGGACAUCGUCCGGG CAGCCCUU | 7650 |
| 1509 | AGGGCUGG G UGGCCACA | 5976 | UGUGGCCA GGAGGAAACUCC CU UCAAGGACAUCGUCCGGG CCAGCCCU | 7651 |
| 1511 | GGCUGGGU G GCCACAAC | 7080 | GUUGUGGC GGAGGAAACUCC CU UCAAGGACAUCGUCCGGG ACCCAGCC | 7652 |
| 1512 | GCUGGGUG G CCACAACU | 5977 | AGUUGUGG GGAGGAAACUCC CU UCAAGGACAUCGUCCGGG CACCCAGC | 7653 |
| 1521 | CCACAACU G GAUGCCA | 7081 | UGGCAUCC GGAGGAAACUCC CU UCAAGGACAUCGUCCGGG AGUUGUGG | 7654 |
| 1522 | CACAACUG G AUGCCAC | 7082 | GUGGCAUC GGAGGAAACUCC CU UCAAGGACAUCGUCCGGG CAGUUGUG | 7655 |
| 1523 | ACAACUGG A UGCCACC | 7083 | GGUGGCAU GGAGGAAACUCC CU UCAAGGACAUCGUCCGGG CCAGUUGU | 7656 |
| 1526 | ACUCGGAU G CCACCUGG | 5978 | CCAGGUGG GGAGGAAACUCC CU UCAAGGACAUCGUCCGGG AUCCGAGU | 7657 |
| 1533 | UGCCACCU G GAGCCCCA | 7084 | UGGGGCUC GGAGGAAACUCC CU UCAAGGACAUCGUCCGGG AGGUGGCA | 7658 |
| 1534 | GCCACCUG G AGCCCCAC | 7085 | GUGGGGCU GGAGGAAACUCC CU UCAAGGACAUCGUCCGGG CAGGUGGC | 7659 |
| 1536 | CACCUGGA G CCCCACCC | 5979 | GGGUGGGG GGAGGAAACUCC CU UCAAGGACAUCGUCCGGG UCCAGGUG | 7660 |
| 1546 | CCCACCCA G AGCUGGCC | 7086 | GCCAGCUC GGAGGAAACUCC CU UCAAGGACAUCGUCCGGG UGGGUGGG | 7661 |
| 1547 | CCACCCAG A GCUGGCCG | 7087 | GGCCAGCU GGAGGAAACUCC CU UCAAGGACAUCGUCCGGG CUGGGUGG | 7662 |
| 1549 | ACCCAGGA G CUGGCCGC | 5980 | GCGGCCAG GGAGGAAACUCC CU UCAAGGACAUCGUCCGGG UCCUGGGU | 7663 |
| 1552 | CAGGAGCU G GCCGCGGC | 7088 | GCCGCGGC GGAGGAAACUCC CU UCAAGGACAUCGUCCGGG AGCUCCUG | 7664 |
| 1553 | AGGAGCUG G CCGCGGCA | 5981 | UGCCGCGG GGAGGAAACUCC CU UCAAGGACAUCGUCCGGG CAGCUCCU | 7665 |
| 1556 | AGCUGGCC G CGGCACCU | 5982 | AGGUGCCG GGAGGAAACUCC CU UCAAGGACAUCGUCCGGG GGCCAGCU | 7666 |
| 1558 | CUGGCCGC G GCACCUUA | 7089 | UAAGGUGC GGAGGAAACUCC CU UCAAGGACAUCGUCCGGG GCGGCCAG | 7667 |
| 1559 | UGGCCGCG G CACCUUAC | 5983 | GUAAGGUG GGAGGAAACUCC CU UCAAGGACAUCGUCCGGG CGCGGCCA | 7668 |
| 1568 | CACCUUAC G CUUCAGCU | 5984 | AGCUGAAG GGAGGAAACUCC CU UCAAGGACAUCGUCCGGG GUAAGGUG | 7669 |
| 1574 | ACGCUUCA G CUGUUGAU | 5985 | AUCAACAG GGAGGAAACUCC CU UCAAGGACAUCGUCCGGG UGAAGCGU | 7670 |
| 1577 | CUUCAGCU G UUGAUCCG | 5986 | CGGAUCAA GGAGGAAACUCC CU UCAAGGACAUCGUCCGGG AGCUGAAG | 7671 |
| 1580 | CAGCUGUU G AUCCGCUG | 7090 | CAGCGGAU GGAGGAAACUCC CU UCAAGGACAUCGUCCGGG AACAGCUG | 7672 |
| 1585 | GUUGAUCC G CUGGUCCC | 5987 | GGGACCAG GGAGGAAACUCC CU UCAAGGACAUCGUCCGGG GGAUCAAC | 7673 |
| 1588 | GAUCCGCU G GUCCCCUC | 7091 | CAGGGGAC GGAGGAAACUCC CU UCAAGGACAUCGUCCGGG AGCGGAUC | 7674 |
| 1589 | AUCCGCUG G UCCCCUCU | 5988 | AGAGGGGA GGAGGAAACUCC CU UCAAGGACAUCGUCCGGG CAGCGGAU | 7675 |
| 1601 | CCUCUUUU G GGUAGAU | 7092 | AUCUACCC GGAGGAAACUCC CU UCAAGGACAUCGUCCGGG AAAAGAGG | 7676 |
| 1602 | CUCUUUUG G GUAGAUG | 7093 | CAUCUACC GGAGGAAACUCC CU UCAAGGACAUCGUCCGGG CAAAAGAG | 7677 |
| 1603 | UCUUUUGG G UAGAUGC | 7094 | GCAUCUAC GGAGGAAACUCC CU UCAAGGACAUCGUCCGGG CCAAAAGA | 7678 |
| 1604 | CUUUUGGG U AGAUGCG | 5989 | CGCAUCUA GGAGGAAACUCC CU UCAAGGACAUCGUCCGGG CCCAAAAG | 7679 |
| 1607 | UUGGGUA G AUGCGGCC | 7095 | GGCCGCAU GGAGGAAACUCC CU UCAAGGACAUCGUCCGGG UACCCCAA | 7680 |
| 1610 | GGGUAGAU G CGGCCCCG | 5990 | CGGGGCCG GGAGGAAACUCC CU UCAAGGACAUCGUCCGGG AUCUACCC | 7681 |
| 1612 | GUAGAUGC G GCCCCGAU | 7096 | AUCGGGGC GGAGGAAACUCC CU UCAAGGACAUCGUCCGGG GCAUCUAC | 7682 |
| 1613 | UAGAUGCG G CCCCGAUC | 5991 | CAUCGGGG GGAGGAAACUCC CU UCAAGGACAUCGUCCGGG CGCAUCUA | 7683 |
| 1618 | GCGGCCCC G AUCAGGCC | 7097 | GGCCUGAU GGAGGAAACUCC CU UCAAGGACAUCGUCCGGG GGGGCCGC | 7684 |
| 1623 | CCCGAUCA G GCCUGACU | 7098 | AGUCAGGC GGAGGAAACUCC CU UCAAGGACAUCGUCCGGG UGAUCGGG | 7685 |
| 1624 | CCGAUCAG G CCUGACUC | 5992 | GAGUCAGG GGAGGAAACUCC CU UCAAGGACAUCGUCCGGG CUGAUCGG | 7686 |
| 1628 | UCAGGCCU G ACUCGCUG | 7099 | CAGCGAGU GGAGGAAACUCC CU UCAAGGACAUCGUCCGGG AGGCCUGA | 7687 |
| 1633 | CCUGACUC G CUGCUCUU | 5993 | AAGAGCAG GGAGGAAACUCC CU UCAAGGACAUCGUCCGGG GAGUCAGC | 7688 |
| 1636 | GACUCGCU G CUCUUUUU | 5994 | AAAAAGAG GGAGGAAACUCC CU UCAAGGACAUCGUCCGGG AGCGAGUC | 7689 |
| 1645 | CUCUUUUU G UUCCCUUC | 5995 | GAAGGGAA GGAGGAAACUCC CU UCAAGGACAUCGUCCGGG AAAAAGAG | 7690 |

TABLE VII-continued

Human IKK-gamma Amberzyme and Substrate Sequence

| Pos | Substrate | Seq ID | Amberzyme | Seq ID |
|---|---|---|---|---|
| 1655 | UCCCUUCU G UCUGCUCG | 5996 | CGAGCAGA GGAGGAAACUCC CU UCAAGGACAUCGUCCGGG AGAAGGGA | 7691 |
| 1659 | UUCUGUCU G CUCGAACC | 5997 | GGUUCGAG GGAGGAAACUCC CU UCAAGGACAUCGUCCGGG AGACAGAA | 7692 |
| 1663 | GUCUGCUC G AACCACUU | 7100 | AAGUGGUU GGAGGAAACUCC CU UCAAGGACAUCGUCCGGG GACCAGAC | 7693 |
| 1672 | AACCACUU G CCUCGGGC | 5998 | GCCCGAGG GGAGGAAACUCC CU UCAAGGACAUCGUCCGGG AAGUGGUU | 7694 |
| 1677 | CUUGCCUC G GGCUAAUC | 7101 | GAUUAGCC GGAGGAAACUCC CU UCAAGGACAUCGUCCGGG GAGGCAAG | 7695 |
| 1678 | UUGCCUCG G GCUAAUCC | 7102 | GGAUUAGC GGAGGAAACUCC CU UCAAGGACAUCGUCCGGG CGAGGCAA | 7696 |
| 1679 | UGCCUCGG G CUAAUCCC | 5999 | GGGAUUAG GGAGGAAACUCC CU UCAAGGACAUCGUCCGGG CCGAGGCA | 7697 |
| 1705 | CUCCACCC G GCACUGGG | 7103 | CCCAGUGC GGAGGAAACUCC CU UCAAGGACAUCGUCCGGG GGGUGGAG | 7698 |
| 1706 | UCCACCCG G CACUGGGG | 6000 | CCCCAGUG GGAGGAAACUCC CU UCAAGGACAUCGUCCGGG CGGUGGA | 7699 |
| 1711 | CCGGCACU G GGAAGUC | 7104 | GACUUCCC GGAGGAAACUCC CU UCAAGGACAUCGUCCGGG AGUGCCGG | 7700 |
| 1712 | CGGCACUG G GGAAGUCA | 7105 | UGACUUCC GGAGGAAACUCC CU UCAAGGACAUCGUCCGGG CAGUGCCG | 7701 |
| 1713 | GGCACUGG G AAGUCAA | 7106 | UUGACUUC GGAGGAAACUCC CU UCAAGGACAUCGUCCGGG CCAGUGCC | 7702 |
| 1714 | GCACUGGG G AAGUCAAG | 7107 | CUUGACUU GGAGGAAACUCC CU UCAAGGACAUCGUCCGGG CCCAGUGC | 7703 |
| 1717 | CUGGGGAA G UCAAGAAU | 6001 | AUUCUUGA GGAGGAAACUCC CU UCAAGGACAUCGUCCGGG UUCCCCAG | 7704 |
| 1722 | GAAGUCAA G AAUGGGGC | 7108 | GCCCCAUU GGAGGAAACUCC CU UCAAGGACAUCGUCCGGG UUGACUUC | 7705 |
| 1726 | UCAAGAAU G CGGCCUGG | 7109 | CCAGGCCC GGAGGAAACUCC CU UCAAGGACAUCGUCCGGG AUUCUUGA | 7706 |
| 1727 | CAAGAAUG G GGCCUGGG | 7110 | CCCACGCC GGAGGAAACUCC CU UCAAGGACAUCGUCCGGG CAUUCUUG | 7707 |
| 1728 | AAGAAUGG G GCCUGGGG | 7111 | CCCCAGGC GGAGGAAACUCC CU UCAAGGACAUCGUCCGGG CCAUUCUU | 7708 |
| 1729 | AGAAUGGG G CCUGGGGC | 6002 | GCCCCAGG GGAGGAAACUCC CU UCAAGGACAUCGUCCGGG CCCAUUCU | 7709 |
| 1733 | UGGGGCCU G GGGCUCUC | 7112 | GAGAGCCC GGAGGAAACUCC CU UCAAGGACAUCGUCCGGG AGGCCCCA | 7710 |
| 1734 | GGGGCCUG G GGCUCUCA | 7113 | UGAGAGCC GGAGGAAACUCC CU UCAAGGACAUCGUCCGGG CAGGCCCC | 7711 |
| 1735 | GGGCCUGG G GCUCUCAG | 7114 | CUGAGAGC GGAGGAAACUCC CU UCAAGGACAUCGUCCGGG CCAGGCCC | 7712 |
| 1736 | GGCCUGGG G CUCUCAGG | 6003 | CCUGAGAG GGAGGAAACUCC CU UCAAGGACAUCGUCCGGG CCCAGGCC | 7713 |
| 1743 | GGCUCUCA G GAGAACU | 7115 | AGUUCUCC GGAGGAAACUCC CU UCAAGGACAUCGUCCGGG UGAGAGCC | 7714 |
| 1744 | GCUCUCAG G AGAACGC | 7116 | CAGUUCUC GGAGGAAACUCC CU UCAAGGACAUCGUCCGGG CUGAGAGC | 7715 |
| 1745 | CUCUCAGG G AGAACGC | 7117 | GCAGUUCU GGAGGAAACUCC CU UCAAGGACAUCGUCCGGG CCUGAGAC | 7716 |
| 1747 | CUCAGGGA G AACUGCUU | 7118 | AAGCAGUU GGAGGAAACUCC CU UCAAGGACAUCGUCCGGG UCCCUGAG | 7717 |
| 1752 | GGAGAACU G CUUCCCU | 6004 | AGGGGAAG GGAGGAAACUCC CU UCAAGGACAUCGUCCGGG AGUUCUCC | 7718 |
| 1761 | CUUCCCCU G GCAGAGCU | 7119 | AGCUCUGC GGAGGAAACUCC CU UCAAGGACAUCGUCCGGG AGGGGAAG | 7719 |
| 1762 | UUCCCCUG G CAGAGCUG | 6005 | CAGCUCUG GGAGGAAACUCC CU UCAAGGACAUCGUCCGGG CAGGGGAA | 7720 |
| 1765 | CCCUGGCA G AGCUGGGU | 7120 | ACCCAGCU GGAGGAAACUCC CU UCAAGGACAUCGUCCGGG UGCCAGGG | 7721 |
| 1767 | CUGGCAGA G CUGGGUGG | 6006 | CCACCCAG GGAGGAAACUCC CU UCAAGGACAUCGUCCGGG UCUGCCAG | 7722 |
| 1770 | GCAGAGCU G GUGGCAGC | 7121 | CUGCCACC GGAGGAAACUCC CU UCAAGGACAUCGUCCGGG AGCUCUGC | 7723 |
| 1771 | CAGAGCUG G UGGCAGCU | 7122 | GCUGCCAC GGAGGAAACUCC CU UCAAGGACAUCGUCCGGG CAGCUCUG | 7724 |
| 1772 | AGAGCUGG G UGGCAGCU | 6007 | AGCUGCCA GGAGGAAACUCC CU UCAAGGACAUCGUCCGGG CCAGCUCU | 7725 |
| 1774 | AGCUGGGU G GCAGCUCU | 7123 | AGAGCUGC GGAGGAAACUCC CU UCAAGGACAUCGUCCGGG ACCCAGCU | 7726 |
| 1775 | GCUGGGUG G CAGCUCUU | 6008 | AAGAGCUG GGAGGAAACUCC CU UCAAGGACAUCGUCCGGG CACCCAGC | 7727 |
| 1778 | CGCUGGCA G CUCUUCCU | 6009 | AGGAAGAG GGAGGAAACUCC CU UCAAGGACAUCGUCCGGG UGCCACCC | 7728 |
| 1793 | CUCCCACC G GACACCGA | 7124 | UCGGUGUC GGAGGAAACUCC CU UCAAGGACAUCGUCCGGG GGUGGGAC | 7729 |
| 1794 | UCCCACCG G ACACCGAC | 7125 | GUCGGUGU GGAGGAAACUCC CU UCAAGGACAUCGUCCGGG CGGUGGGA | 7730 |
| 1800 | CGGACACC G ACCCGCCC | 7126 | GGGCGGGU GGAGGAAACUCC CU UCAAGGACAUCGUCCGGG GGUGUCCG | 7731 |
| 1805 | ACCGACCC G CCCGCCGC | 6010 | GCGGCGGG GGAGGAAACUCC CU UCAAGGACAUCGUCCGGG GGGUCGGU | 7732 |
| 1809 | ACCCGCCC G CCGCUGUG | 6011 | CACAGCGG GGAGGAAACUCC CU UCAAGGACAUCGUCCGGG GGGCGGGU | 7733 |
| 1812 | CGCCCGCC G CUGUGCCC | 6012 | GGGCACAG GGAGGAAACUCC CU UCAAGGACAUCGUCCGGG GGCGGGCG | 7734 |
| 1815 | CCGCCGCU G UGCCCUGG | 6013 | CCAGGGCA GGAGGAAACUCC CU UCAAGGACAUCGUCCGGG AGCGGCGG | 7735 |
| 1817 | GCCGCUGU G CCCUGGGA | 6014 | UCCCAGGG GGAGGAAACUCC CU UCAAGGACAUCGUCCGGG ACAGCGGC | 7736 |
| 1822 | UGUGCCCU G GAGUGCU | 7127 | AGCACUCC GGAGGAAACUCC CU UCAAGGACAUCGUCCGGG AGGGCACA | 7737 |
| 1823 | GUGCCCUG G AGUGCUG | 7128 | CAGCACUC GGAGGAAACUCC CU UCAAGGACAUCGUCCGGG CAGGGCAC | 7738 |
| 1824 | UGCCCUGG G AGUGCUGC | 7129 | GCAGCACU GGAGGAAACUCC CU UCAAGGACAUCGUCCGGG CCAGGGCA | 7739 |
| 1826 | CCCUGGGA G UGCUGCGC | 6015 | GGGCAGCA GGAGGAAACUCC CU UCAAGGACAUCGUCCGGG UCCCAGGG | 7740 |
| 1828 | CUGGGAGU G CUGCCUC | 6016 | GAGGGCAG GGAGGAAACUCC CU UCAAGGACAUCGUCCGGG ACUCCCAG | 7741 |
| 1831 | GGAGUGCU G CCCUCUUA | 6017 | UAAGAGGG GGAGGAAACUCC CU UCAAGGACAUCGUCCGGG AGCACUCC | 7742 |
| 1844 | CUUACCAU G CACACGGG | 6018 | CCCGUGUG GGAGGAAACUCC CU UCAAGGACAUCGUCCGGG AUGGUAAG | 7743 |
| 1850 | AUGCACAC G GGUGCUCU | 7130 | AGAGCACC GGAGGAAACUCC CU UCAAGGACAUCGUCCGGG GUGUGCAU | 7744 |
| 1851 | UGCACACG G GUGCUCUC | 7131 | GAGAGCAC GGAGGAAACUCC CU UCAAGGACAUCGUCCGGG CGUGUGCA | 7745 |
| 1852 | GCACACGG G UGCUCUCC | 6019 | GGAGAGCA GGAGGAAACUCC CU UCAAGGACAUCGUCCGGG CCGUGUGC | 7746 |
| 1854 | ACACGGGU G CUCUCCUU | 6020 | AAGGAGAG GGAGGAAACUCC CU UCAAGGACAUCGUCCGGG ACCCGUGU | 7747 |
| 1865 | CUCCUUUU G GCUGCAU | 7132 | AUGCAGCC GGAGGAAACUCC CU UCAAGGACAUCGUCCGGG AAAAGGAG | 7748 |
| 1866 | UCCUUUUG G CUGCAUG | 7133 | CAUGCAGC GGAGGAAACUCC CU UCAAGGACAUCGUCCGGG CAAAAGGA | 7749 |
| 1867 | CCUUUUGG G CUGCAUGC | 6021 | GCAUGCAG GGAGGAAACUCC CU UCAAGGACAUCGUCCGGG CCAAAAGG | 7750 |
| 1870 | UUGGGCU G CAUGCUAU | 6022 | AUAGCAUG GGAGGAAACUCC CU UCAAGGACAUCGUCCGGG AGCCCAAA | 7751 |
| 1874 | GGCUGCAU G CUAUUCCA | 6023 | UGGAAUAG GGAGGAAACUCC CU UCAAGGACAUCGUCCGGG AUGCAGCC | 7752 |
| 1887 | UCCAUUUU G CAGCCAGA | 6024 | UCUGGCUG GGAGGAAACUCC CU UCAAGGACAUCGUCCGGG AAAAUGGA | 7753 |
| 1890 | AUUUUGCA G CCAGACCG | 6025 | CGGUCUGG GGAGGAAACUCC CU UCAAGGACAUCGUCCGGG UGCAAAAU | 7754 |
| 1894 | UGCAGCCA G ACCGAUGU | 7134 | ACAUCGGU GGAGGAAACUCC CU UCAAGGACAUCGUCCGGG UGGCUGCA | 7755 |
| 1898 | GCCAGACC G AUGUAUU | 7135 | AUACACAU GGAGGAAACUCC CU UCAAGGACAUCGUCCGGG GGUCUGGC | 7756 |
| 1901 | AGACCGAU G UAUUUA | 6026 | UAAAUACA GGAGGAAACUCC CU UCAAGGACAUCGUCCGGG AUCGGUCU | 7757 |
| 1903 | ACCGAUGU G UAUUUAAC | 6027 | GUUAAAUA GGAGGAAACUCC CU UCAAGGACAUCGUCCGGG ACAUCGGU | 7758 |
| 1914 | UUUAACCA G UCACUAUU | 6028 | AAUAGUGA GGAGGAAACUCC CU UCAAGGACAUCGUCCGGG UGGUUAAA | 7759 |
| 1923 | UCACUAUU G AUGGACAU | 7136 | AUGUCCAU GGAGGAAACUCC CU UCAAGGACAUCGUCCGGG AAUAGUGA | 7760 |
| 1926 | CUAUUGAU G GACAUUUG | 7137 | CAAAUGUC GGAGGAAACUCC CU UCAAGGACAUCGUCCGGG AUCAAUAG | 7761 |
| 1927 | UAUUGAUG G ACAUUUGG | 7138 | CCAAAUGU GGAGGAAACUCC CU UCAAGGACAUCGUCCGGG CAUCAAUA | 7762 |
| 1934 | GGACAUUU G GUUGUUU | 7139 | AAACAACC GGAGGAAACUCC CU UCAAGGACAUCGUCCGGG AAAUGUCC | 7763 |
| 1935 | GACAUUUG G UUGUUUC | 7140 | GAAACAAC GGAGGAAACUCC CU UCAAGGACAUCGUCCGGG CAAAUGUC | 7764 |
| 1936 | ACAUUUGG G UUGUUUCC | 6029 | GGAAACAA GGAGGAAACUCC CU UCAAGGACAUCGUCCGGG CCAAAUGU | 7765 |

TABLE VII-continued

Human IKK-gamma Amberzyme and Substrate Sequence

| Pos | Substrate | Seq ID | Amberzyme | Seq ID |
|-----|-----------|--------|-----------|--------|
| 1939 | UUUGGGUU G UUUCCCAU | 6030 | AUGGGAAA GGAGGAAACUCC CU UCAAGGACAUCGUCCGGG AACCCAAA | 7766 |
| 1954 | AUCUUUUU G UUACCAUA | 6031 | UAUGGUAA GGAGGAAACUCC CU UCAAGGACAUCGUCCGGG AAAAAGAU | 7767 |
| 1969 | UAAAUAAU G GCAUAGUA | 7141 | UACUAUGC GGAGGAAACUCC CU UCAAGGACAUCGUCCGGG AUUAUUUA | 7768 |
| 1970 | AAAUAAUG G CAUAGUAA | 6032 | UUACUAUG GGAGGAAACUCC CU UCAAGGACAUCGUCCGGG CAUUAUUU | 7769 |
| 1975 | AUGGCAUA G UAAAAAAA | 6033 | UUUUUUUA GGAGGAAACUCC CU UCAAGGACAUCGUCCGGG UAUGCCAU | 7770 |

Input Sequence = NM_003639. Cut Site = G/.
Arm Length = 8. Core Sequence = GGAGGAAACUCC CU UCAAGGACAUCGUCCGGG NM_003639 (*Homo sapiens* inhibitor of kappa light polypeptide gene enhancer in B-cells, kin (IKBKG), mRNA.; 1994 bp)

TABLE VIII

Human PKR Hammerhead and Substrate Sequence

| Pos | Substrate | Seq ID | Hammerhead | Seq ID |
|-----|-----------|--------|------------|--------|
| 20 | GGCGCAGU U UGCUCAUA | 1 | UAUGAGCA CUGAUGAGGCCGUUAGGCCGAA ACUGCGCC | 632 |
| 21 | GCGCAGUU U GCUCAUAC | 2 | GUAUGAGC CUGAUGAGGCCGUUAGGCCGAA AACUGCGC | 633 |
| 25 | AGUUUGCU C AUACUUUG | 3 | CAAAGUAU CUGAUGAGGCCGUUAGGCCGAA AGCAAACU | 634 |
| 28 | UUGCUCAU A CUUUGUGA | 4 | UCACAAAG CUGAUGAGGCCGUUAGGCCGAA AUGAGCAA | 635 |
| 31 | CUCAUACU U UGUGACUU | 5 | AAGUCACA CUGAUGAGGCCGUUAGGCCGAA AGUAUGAG | 636 |
| 32 | UCAUACUU U GUGACUUG | 6 | CAAGUCAC CUGAUGAGGCCGUUAGGCCGAA AAGUAUGA | 637 |
| 39 | UUGUGACU U GCGGUCAC | 7 | GUGACCGC CUGAUGAGGCCGUUAGGCCGAA AGUCACAA | 638 |
| 45 | CUUGCGGU C ACAGUGGC | 8 | GCCACUGU CUGAUGAGGCCGUUAGGCCGAA ACCGCAAG | 639 |
| 56 | AGUGGCAU U CAGCUCCA | 9 | UGGAGCUG CUGAUGAGGCCGUUAGGCCGAA AUGCCACU | 640 |
| 57 | GUGGCAUU C AGCUCCAC | 10 | GUGGAGCU CUGAUGAGGCCGUUAGGCCGAA AAUGCCAC | 641 |
| 62 | AUUCAGCU C CACACUUG | 11 | CAAGUGUG CUGAUGAGGCCGUUAGGCCGAA AGCUGAAU | 642 |
| 69 | UCCACACU U GGUAGAAC | 12 | GUUCUACC CUGAUGAGGCCGUUAGGCCGAA AGUGUGGA | 643 |
| 73 | CACUUGGU A GAACCACA | 13 | UGUGGUUC CUGAUGAGGCCGUUAGGCCGAA ACCAAGUG | 644 |
| 96 | ACAAGCAU A GAAACAUC | 14 | GAUGUUUC CUGAUGAGGCCGUUAGGCCGAA AUGCUUGU | 645 |
| 104 | AGAAACAU C CUAAACAA | 15 | UUGUUUAG CUGAUGAGGCCGUUAGGCCGAA AUGUUUCU | 646 |
| 107 | AACAUCCU A AACAAUCU | 16 | AGAUUGUU CUGAUGAGGCCGUUAGGCCGAA AGGAUGUU | 647 |
| 114 | UAAACAAU C UUCAUCGA | 17 | UCGAUGAA CUGAUGAGGCCGUUAGGCCGAA AUUGUUUA | 648 |
| 116 | AACAAUCU U CAUCGAGG | 18 | CCUCGAUG CUGAUGAGGCCGUUAGGCCGAA AGAUUGUU | 649 |
| 117 | ACAAUCUU C AUCGAGGC | 19 | GCCUCGAU CUGAUGAGGCCGUUAGGCCGAA AAGAUUGU | 650 |
| 120 | AUCUUCAU C GAGGCAUC | 20 | GAUGCCUC CUGAUGAGGCCGUUAGGCCGAA AUGAAGAU | 651 |
| 128 | CGAGGCAU C GAGGUCCA | 21 | UGGACCUC CUGAUGAGGCCGUUAGGCCGAA AUGCCUCG | 652 |
| 134 | AUCGAGGU C CAUCCCAA | 22 | UUGGGAUG CUGAUGAGGCCGUUAGGCCGAA ACCUCGAU | 653 |
| 138 | AGGUCCAU C CCAAUAAA | 23 | UUUAUUGG CUGAUGAGGCCGUUAGGCCGAA AUGGACCU | 654 |
| 144 | AUCCCAAU A AAAUCAG | 24 | CUGAUUUU CUGAUGAGGCCGUUAGGCCGAA AUUGGGAU | 655 |
| 150 | AUAAAAAU C AGGAGACC | 25 | GGUCUCCU CUGAUGAGGCCGUUAGGCCGAA AUUUUUAU | 656 |
| 165 | CCCUGGCU A UCAUAGAC | 26 | GUCUAUGA CUGAUGAGGCCGUUAGGCCGAA AGCCAGGG | 657 |
| 167 | CUGGCUAU C AUAGACCU | 27 | AGGUCUAU CUGAUGAGGCCGUUAGGCCGAA AUAGCCAG | 658 |
| 170 | GCUAUCAU A GACCUUAG | 28 | CUAAGGUC CUGAUGAGGCCGUUAGGCCGAA AUGAUAGC | 659 |
| 176 | AUAGACCU U AGUCUUCG | 29 | CGAAGACU CUGAUGAGGCCGUUAGGCCGAA AGGUCUAU | 660 |
| 177 | UAGACCUU A GUCUUCGC | 30 | GCGAAGAC CUGAUGAGGCCGUUAGGCCGAA AAGGUCUA | 661 |
| 180 | ACCUUAGU C UUCGCUGG | 31 | CCAGCGAA CUGAUGAGGCCGUUAGGCCGAA ACUAAGGU | 662 |
| 182 | CUUAGUCU U CGCUGGUA | 32 | UACCAGCG CUGAUGAGGCCGUUAGGCCGAA AGACUAAG | 663 |
| 183 | UUAGUCUU C GCUGGUAU | 33 | AUACCAGC CUGAUGAGGCCGUUAGGCCGAA AAGACUAA | 664 |
| 190 | UCGCUGGU A UACUCGCU | 34 | AGCGAGUA CUGAUGAGGCCGUUAGGCCGAA ACCAGCGA | 665 |
| 192 | GCUGGUAU A CUCGCUGU | 35 | ACAGCGAG CUGAUGAGGCCGUUAGGCCGAA AUACCAGC | 666 |
| 195 | GGUAUACU C GCUGCUG | 36 | CAGACAGC CUGAUGAGGCCGUUAGGCCGAA AGUAUACC | 667 |
| 201 | CUCGCUGU C UGUCAACC | 37 | GGUUGACA CUGAUGAGGCCGUUAGGCCGAA ACAGCGAG | 668 |
| 205 | CUGUCUGU C AACCAGCG | 38 | CGCUGGUU CUGAUGAGGCCGUUAGGCCGAA ACAGACAG | 669 |
| 216 | CCAGCGGU U GACUUUUU | 39 | AAAAAGUC CUGAUGAGGCCGUUAGGCCGAA ACCGCUGG | 670 |
| 221 | GGUUGACU U UUUUAAG | 40 | CUUAAAAA CUGAUGAGGCCGUUAGGCCGAA AGUCAACC | 671 |
| 222 | GUUGACUU U UUUAAGC | 41 | GCUUAAAA CUGAUGAGGCCGUUAGGCCGAA AAGUCAAC | 672 |
| 223 | UUGACUUU U UUAAGCC | 42 | GGCUUAAA CUGAUGAGGCCGUUAGGCCGAA AAAGUCAA | 673 |
| 224 | UGACUUUU U UAAGCCU | 43 | AGGCUUAA CUGAUGAGGCCGUUAGGCCGAA AAAAGUCA | 674 |
| 225 | GACUUUUU U AAGCCUU | 44 | AAGGCUUA CUGAUGAGGCCGUUAGGCCGAA AAAAAGUC | 675 |
| 226 | ACUUUUUU U AAGCCUUC | 45 | GAAGGCUU CUGAUGAGGCCGUUAGGCCGAA AAAAAAGU | 676 |
| 227 | CUUUUUUU A AGCCUUCU | 46 | AGAAGGCU CUGAUGAGGCCGUUAGGCCGAA AAAAAAAG | 677 |
| 233 | UUAAGCCU U CUUUUUUC | 47 | GAAAAAAG CUGAUGAGGCCGUUAGGCCGAA AGGCUUAA | 678 |
| 234 | UAAGCCUU C UUUUUUCU | 48 | AGAAAAAA CUGAUGAGGCCGUUAGGCCGAA AAGGCUUA | 679 |
| 236 | AGCCUUCU U UUUUCUCU | 49 | AGAGAAAA CUGAUGAGGCCGUUAGGCCGAA AGAAc3GCU | 680 |
| 237 | GCCUUCUU U UUUCUCUU | 50 | AAGAGAAA CUGAUGAGGCCGUUAGGCCGAA AAGAAGGC | 681 |
| 238 | CCUUCUUU U UUCUCUUU | 51 | AAAGAGAA CUGAUGAGGCCGUUAGGCCGAA AAAGAAGG | 682 |
| 239 | CUUCUUUU U UCUCUUUU | 52 | AAAAGAGA CUGAUGAGGCCGUUAGGCCGAA AAAAGAAG | 683 |
| 240 | UUCUUUUU U CUCUUUUA | 53 | UAAAAGAG CUGAUGAGGCCGUUAGGCCGAA AAAAAGAA | 684 |
| 241 | UCUUUUUU C UCUUUUAC | 54 | GUAAAAGA CUGAUGAGGCCGUUAGGCCGAA AAAAAGAA | 685 |
| 243 | UUUUUUCU C UUUUACCA | 55 | UGGUAAAA CUGAUGAGGCCGUUAGGCCGAA AGAAAAAA | 686 |
| 245 | UUUUCUCU U UUACCAGU | 56 | ACUGGUAA CUGAUGAGGCCGUUAGGCCGAA AGAGAAAA | 687 |
| 246 | UUUCUCUU U UACCAGUU | 57 | AACUGGUA CUGAUGAGGCCGUUAGGCCGAA AAGAGAAA | 688 |

TABLE VIII-continued

Human PKR Hammerhead and Substrate Sequence

| Pos | Substrate | Seq ID | Hammerhead | Seq ID |
|---|---|---|---|---|
| 247 | UUCUCUUU U ACCAGUUU | 58 | AAACUGGU CUGAUGAGGCCGUUAGGCCGAA AAAGAGAA | 689 |
| 248 | UCUCUUUU A CCAGUUUC | 59 | GAAACUGG CUGAUGAGGCCGUUAGGCCGAA AAAAGAGA | 690 |
| 254 | UUACCAGU U UCUGGAGC | 60 | GCUCCAGA CUGAUGAGGCCGUUAGGCCGAA ACUGGUAA | 691 |
| 255 | UACCAGUU C CUGGAGCA | 61 | UGCUCCAG CUGAUGAGGCCGUUAGGCCGAA AACUGGUA | 692 |
| 256 | ACCAGUUU C UGGAGCAA | 62 | UUGCUCCA CUGAUGAGGCCGUUAGGCCGAA AAACUGGU | 693 |
| 267 | GAGCAAAU U CAGUUUGC | 63 | GCAAACUG CUGAUGAGGCCGUUAGGCCGAA AUUUGCUC | 694 |
| 268 | AGCAAAUU C AGUUUGCC | 64 | GGCAAACU CUGAUGAGGCCGUUAGGCCGAA AAUUUGCU | 695 |
| 272 | AAUUCAGU U UGCCUUCC | 65 | GGAAGGCA CUGAUGAGGCCGUUAGGCCGAA ACUGAAUU | 696 |
| 273 | AUUCAGUU U GCCUUCCU | 66 | AGGAAGGC CUGAUGAGGCCGUUAGGCCGAA AACUGAAU | 697 |
| 278 | GUUUGCCU U CCUGGAUU | 67 | AAUCCAGG CUGAUGAGGCCGUUAGGCCGAA AGGCAAAC | 698 |
| 279 | UUUGCCUU C CUGGAUUU | 68 | AAAUCCAG CUGAUGAGGCCGUUAGGCCGAA AAGGCAAA | 699 |
| 286 | UCCUGGAU U UGUAAAUU | 69 | AAUUUACA CUGAUGAGGCCGUUAGGCCGAA AUCCAGGA | 700 |
| 287 | CCUGGAUU U GUAAAUUG | 70 | CAAUUUAC CUGAUGAGGCCGUUAGGCCGAA AAUCCAGG | 701 |
| 290 | GGAUUUGU A AAUUGUAA | 71 | UUACAAUU CUGAUGAGGCCGUUAGGCCGAA ACAAAUCC | 702 |
| 294 | UUGUAAAU U GUAAUGAC | 72 | GUCAUUAC CUGAUGAGGCCGUUAGGCCGAA AUUUACAA | 703 |
| 297 | UAAAUUGU A AUGACCUC | 73 | GAGGUCAU CUGAUGAGGCCGUUAGGCCGAA ACAAUUUA | 704 |
| 305 | AAUGACCU C AAAACUUU | 74 | AAAGUUUU CUGAUGAGGCCGUUAGGCCGAA AGGUCAUU | 705 |
| 312 | UCAAAACU U UAGCAGUU | 75 | AACUGCUA CUGAUGAGGCCGUUAGGCCGAA AGUUUUGA | 706 |
| 313 | CAAAACUU U AGCAGUUC | 76 | GAACUGCU CUGAUGAGGCCGUUAGGCCGAA AAGUUUUG | 707 |
| 314 | AAAACUUU A GCAGUUCU | 77 | AGAACUGC CUGAUGAGGCCGUUAGGCCGAA AAAGUUUU | 708 |
| 320 | UUAGCAGU U CUUCCAUC | 78 | GAUGGAAG CUGAUGAGGCCGUUAGGCCGAA ACUGCUAA | 709 |
| 321 | UAGCAGUU C UUCCAUCU | 79 | AGAUGGAA CUGAUGAGGCCGUUAGGCCGAA AACUGCUA | 710 |
| 323 | GCAGUUCU U CCAUCUGA | 80 | UCAGAUGG CUGAUGAGGCCGUUAGGCCGAA AGAACUGC | 711 |
| 324 | CAGUUCUU C CAUCUGAC | 81 | GUCAGAUG CUGAUGAGGCCGUUAGGCCGAA AAGAACUG | 712 |
| 328 | UCUUCCAU C UGACUCUG | 82 | CUGAGUCA CUGAUGAGGCCGUUAGGCCGAA AUGGAAGA | 713 |
| 334 | AUCUGACU C AGGUUUGC | 83 | GCAAACCU CUGAUGAGGCCGUUAGGCCGAA AGUCAGAU | 714 |
| 339 | ACUCAGGU U UGCUUCUC | 84 | GAGAAGCA CUGAUGAGGCCGUUAGGCCGAA ACCUGAGU | 715 |
| 340 | CUCAGGUU U GCUUCUCU | 85 | AGAGAAGC CUGAUGAGGCCGUUAGGCCGAA AACCUGAG | 716 |
| 344 | GGUUUGCU U CUCUGGCG | 86 | CGCCAGAG CUGAUGAGGCCGUUAGGCCGAA AGCAAACC | 717 |
| 345 | GUUUGCUU C UCUGGCGG | 87 | CCGCCAGA CUGAUGAGGCCGUUAGGCCGAA AAGCAAAC | 718 |
| 347 | UUGCUUCU C UGGCGGUC | 88 | GACCGCCA CUGAUGAGGCCGUUAGGCCGAA AGAAGCAA | 719 |
| 355 | CUGGCGGU C UUCAGAAU | 89 | AUUCUGAA CUGAUGAGGCCGUUAGGCCGAA ACCGCCAG | 720 |
| 357 | GGCGGUCU U CAGAAUCA | 90 | UGAUUCUG CUGAUGAGGCCGUUAGGCCGAA AGACCGCC | 721 |
| 358 | GCGGUCUU C AGAAUCAA | 91 | UUGAUUCU CUGAUGAGGCCGUUAGGCCGAA AAGACCGC | 722 |
| 364 | UUCAGAAU C AACAUCCA | 92 | UGGAUGUU CUGAUGAGGCCGUUAGGCCGAA AUUCUGAA | 723 |
| 370 | AUCAACAU C CACACUUC | 93 | GAAGUGUG CUGAUGAGGCCGUUAGGCCGAA AUGUUGAU | 724 |
| 377 | UCCACACU U CCGUGAUU | 94 | AAUCACGG CUGAUGAGGCCGUUAGGCCGAA AGUGUGGA | 725 |
| 378 | CCACACUU C CGUGAUUA | 95 | UAAUCACG CUGAUGAGGCCGUUAGGCCGAA AAGUGUGG | 726 |
| 385 | UCCGUGAU U AUCUGCGU | 96 | ACGCAGAU CUGAUGAGGCCGUUAGGCCGAA AUCACGGA | 727 |
| 386 | CCGUGAUU A UCUGCGUG | 97 | CACGCAGA CUGAUGAGGCCGUUAGGCCGAA AAUCACGG | 728 |
| 388 | GUGAUUAU C UGCGUGCA | 98 | UGCACGCA CUGAUGAGGCCGUUAGGCCGAA AUAAUCAC | 729 |
| 398 | GCGUGCAU U UGGACAAA | 99 | UUUGUCCA CUGAUGAGGCCGUUAGGCCGAA AUGCACGC | 730 |
| 399 | CGUGCAUU U GGACAAAG | 100 | UUUUGUCC CUGAUGAGGCCGUUAGGCCGAA AAUGCACG | 731 |
| 400 | GUGCAUUU U GGACAAAG | 101 | CUUUGUCC CUGAUGAGGCCGUUAGGCCGAA AAAAUGCAC | 732 |
| 411 | ACAAAGCU U CCAACCAG | 102 | CUGGUUGG CUGAUGAGGCCGUUAGGCCGAA AGCUUUGU | 733 |
| 412 | CAAAGCUU C CAACCAGG | 103 | CCUGGUUG CUGAUGAGGCCGUUAGGCCGAA AAGCUUUG | 734 |
| 423 | ACCAGGAU A CGGAAGAA | 104 | UCUUCCCG CUGAUGAGGCCGUUAGGCCGAA AUCCUGGU | 735 |
| 448 | CUGGUGAU C UUUCAGCA | 105 | UGCUGAAA CUGAUGAGGCCGUUAGGCCGAA AUCACCAG | 736 |
| 450 | GGUGAUCU U UCAGCAGG | 106 | CCUGCUGA CUGAUGAGGCCGUUAGGCCGAA AGAUCACC | 737 |
| 451 | GUGAUCUU U CAGCAGGU | 107 | ACCUGCUG CUGAUGAGGCCGUUAGGCCGAA AAGAUCAC | 738 |
| 452 | UGAUCUUU C AGCAGGUU | 108 | AACCUGCU CUGAUGAGGCCGUUAGGCCGAA AAAGAUCA | 739 |
| 460 | CAGCAGGU U UCUUCAUG | 109 | CAUGAAGA CUGAUGAGGCCGUUAGGCCGAA ACCUGCUG | 740 |
| 461 | AGCAGGUU U CUUCAUGG | 110 | CCAUGAAG CUGAUGAGGCCGUUAGGCCGAA AACCUGCU | 741 |
| 462 | GCAGGUUU C UUCAUGGA | 111 | UCCAUGAA CUGAUGAGGCCGUUAGGCCGAA AAACCUGC | 742 |
| 464 | AGGUUUCU U CAUGGAGG | 112 | CCUCCAUG CUGAUGAGGCCGUUAGGCCGAA AGAAACCU | 743 |
| 465 | GGUUUCUU C AUGGAGGA | 113 | UCCUCCAU CUGAUGAGGCCGUUAGGCCGAA AAGAAACC | 744 |
| 477 | GAGGAACU U AAUACAUA | 114 | UAUGUAUU CUGAUGAGGCCGUUAGGCCGAA AGUUCCUC | 745 |
| 478 | AGGAACUU A AUACAUAC | 115 | GUAUGUAU CUGAUGAGGCCGUUAGGCCGAA AAGUUCCU | 746 |
| 481 | AACUUAAU A CAUACCGU | 116 | ACGGUAUG CUGAUGAGGCCGUUAGGCCGAA AUUAAGUU | 747 |
| 485 | UAAUACAU A CCGUCAGA | 117 | UCUGACGG CUGAUGAGGCCGUUAGGCCGAA AUGUAUUA | 748 |
| 490 | CAUACCGU C AGAAGCAG | 118 | CUGCUUCU CUGAUGAGGCCGUUAGGCCGAA ACGCUAUG | 749 |
| 504 | CAGGGAGU A GUCUUAA | 119 | UUAAGUAC CUGAUGAGGCCGUUAGGCCGAA ACUCCCUG | 750 |
| 507 | GGAGUAGU A CUUAAAUA | 120 | UAUUUAAG CUGAUGAGGCCGUUAGGCCGAA ACUACUCC | 751 |
| 510 | GUAGUACU U AAAUAUCA | 121 | UGAUAUUU CUGAUGAGGCCGUUAGGCCGAA AGUACUAC | 752 |
| 511 | UAGUACUU A AAUAUCAA | 122 | UUGAUAUU CUGAUGAGGCCGUUAGGCCGAA AAGUACUA | 753 |
| 515 | ACUUAAAU A UCAAGAAC | 123 | GUUCUUGA CUGAUGAGGCCGUUAGGCCGAA AUUUAAGU | 754 |
| 517 | UUAAAUAU C AAGAACUG | 124 | CAGUUCUU CUGAUGAGGCCGUUAGGCCGAA AUAUUUAA | 755 |
| 529 | AACUGCCU A AUUCAGGA | 125 | UCCUGAAU CUGAUGAGGCCGUUAGGCCGAA AGGCAGUU | 756 |
| 532 | UGCCUAAU U CAGGACCU | 126 | AGGUCCUG CUGAUGAGGCCGUUAGGCCGAA AUUAGGCA | 757 |
| 533 | GCCUAAUU C AGGACCUC | 127 | GAGGUCCU CUGAUGAGGCCGUUAGGCCGAA AAUUAGGC | 758 |
| 541 | CAGGACCU C CACAUGAU | 128 | AUCAUGUG CUGAUGAGGCCGUUAGGCCGAA AGGUCCUG | 759 |
| 550 | CACAUGAU A GGAGGUUU | 129 | AAACCUCC CUGAUGAGGCCGUUAGGCCGAA AUCAUGUG | 760 |
| 557 | UAGGAGGU U UACAUUUC | 130 | GAAAUGUA CUGAUGAGGCCGUUAGGCCGAA ACCUCCUA | 761 |
| 558 | AGGAGGUU U ACAUUUCA | 131 | UGAAAUGU CUGAUGAGGCCGUUAGGCCGAA AACCUCCU | 762 |
| 559 | GGAGGUUU A CAUUUCAA | 132 | UUGAAAUG CUGAUGAGGCCGUUAGGCCGAA AAACCUCC | 763 |

TABLE VIII-continued

Human PKR Hammerhead and Substrate Sequence

| Pos | Substrate | Seq ID | Hammerhead | Seq ID |
|---|---|---|---|---|
| 563 | GUUUACAU U UCAAGUUA | 133 | UAACUUGA CUGAUGAGGCCGUUAGGCCGAA AUGUAAAC | 764 |
| 564 | UUUACAUU U CAAGUUAU | 134 | AUAACUUG CUGAUGAGGCCGUUAGGCCGAA AAUGUAAA | 765 |
| 565 | UUACAUUU C AAGUUAUA | 135 | UAUAACUU CUGAUGAGGCCGUUAGGCCGAA AAAUGUAA | 766 |
| 570 | UUUCAAGU U AUAAUAGA | 136 | UCUAUUAU CUGAUGAGGCCGUUAGGCCGAA ACUUGAAA | 767 |
| 571 | UUCAAGUU A UAAUAGAU | 137 | AUCUAUUA CUGAUGAGGCCGUUAGGCCGAA AACUUGAA | 768 |
| 573 | CAAGUUAU A AUAGAUGG | 138 | CCAUCUAU CUGAUGAGGCCGUUAGGCCGAA AUAACUUG | 769 |
| 576 | GUUAUAAU A GAUGGAAG | 139 | CUUCCAUC CUGAUGAGGCCGUUAGGCCGAA AUUAUAAC | 770 |
| 590 | AAGAGAAU U UCCAGAAG | 140 | CUUCUGGA CUGAUGAGGCCGUUAGGCCGAA AUUCUCUU | 771 |
| 591 | AGAGAAUU U CCAGAAGG | 141 | CCUUCUGG CUGAUGAGGCCGUUAGGCCGAA AAUUCUCU | 772 |
| 592 | GAGAAUUU C CAGAAGGU | 142 | ACCUUCUG CUGAUGAGGCCGUUAGGCCGAA AAAUUCUC | 773 |
| 607 | GUGAAGGU A GAUCAAAG | 143 | CUUUGAUC CUGAUGAGGCCGUUAGGCCGAA ACCUUCAC | 774 |
| 611 | AGGUAGAU C AAAGAAGG | 144 | CCUUCUUU CUGAUGAGGCCGUUAGGCCGAA AUCUACCU | 775 |
| 644 | AGCCAAAU U AGCUGUUG | 145 | CAACAGCU CUGAUGAGGCCGUUAGGCCGAA AUUUGGCU | 776 |
| 645 | GCCAAAUU A GCUGUUGA | 146 | UCAACAGC CUGAUGAGGCCGUUAGGCCGAA AAUUUGGC | 777 |
| 651 | UUAGCUGU U GAGAUACU | 147 | AGUAUCUC CUGAUGAGGCCGUUAGGCCGAA ACAGCUAA | 778 |
| 657 | GUUGAGAU A CUUAAUAA | 148 | UUAUUAAG CUGAUGAGGCCGUUAGGCCGAA AUCUCAAC | 779 |
| 660 | GAGAUACU U AAUAAGGA | 149 | UCCUUAUU CUGAUGAGGCCGUUAGGCCGAA AGUAUCUC | 780 |
| 661 | AGAUACUU A AUAAGGAA | 150 | UUCCUUAU CUGAUGAGGCCGUUAGGCCGAA AAGUAUCU | 781 |
| 664 | UACUUAAU A AGGAAAAG | 151 | CUUUUCCU CUGAUGAGGCCGUUAGGCCGAA AUUAAGUA | 782 |
| 681 | AAGGCAGU U AGUCCUUU | 152 | AAAGGACU CUGAUGAGGCCGUUAGGCCGAA ACUGCCUU | 783 |
| 682 | AGGCAGUU A GUCCUUUA | 153 | UAAAGGAC CUGAUGAGGCCGUUAGGCCGAA AACUGCCU | 784 |
| 685 | CAGUUAGU C CUUUAUUA | 154 | UAAUAAAG CUGAUGAGGCCGUUAGGCCGAA ACUAACUG | 785 |
| 688 | UUAGUCCU U UAUUAUUG | 155 | CAAUAAUA CUGAUGAGGCCGUUAGGCCGAA AGGACUAA | 786 |
| 689 | UAGUCCUU U AUUAUUGA | 156 | UCAAUAAU CUGAUGAGGCCGUUAGGCCGAA AAGGACUA | 787 |
| 690 | AGUCCUUU A UUAUUGAC | 157 | GUCAAUAA CUGAUGAGGCCGUUAGGCCGAA AAAGGACU | 788 |
| 692 | UCCUUUAU U AUUGACAA | 158 | UUGUCAAU CUGAUGAGGCCGUUAGGCCGAA AUAAAGGA | 789 |
| 693 | CCUUUAUU A UUGACAAC | 159 | GUUGUCAA CUGAUGAGGCCGUUAGGCCGAA AAUAAAGG | 790 |
| 695 | UUUAUUAU U GACAACAA | 160 | UUGUUGUC CUGAUGAGGCCGUUAGGCCGAA AUAAUAAA | 791 |
| 709 | CAACGAUU C UUCAGAA | 161 | UUCUGAAG CUGAUGAGGCCGUUAGGCCGAA AUUCGUUG | 792 |
| 710 | AACGAUUC U UCAGAAG | 162 | CUUCUGAA CUGAUGAGGCCGUUAGGCCGAA AAUUCGUU | 793 |
| 712 | CGAUUCU U CAGAAGGA | 163 | UCCUUCUG CUGAUGAGGCCGUUAGGCCGAA AGAAUUCG | 794 |
| 713 | GAAUUCUC C AGAAGGAU | 164 | AUCCUUCU CUGAUGAGGCCGUUAGGCCGAA AAGAAUUC | 795 |
| 722 | AGAAGGAU U AUCCAUGG | 165 | CCAUGGAU CUGAUGAGGCCGUUAGGCCGAA AUCCUUCU | 796 |
| 723 | GAAGGAUU A UCCAUGGG | 166 | CCCAUGGA CUGAUGAGGCCGUUAGGCCGAA AAUCCUUC | 797 |
| 725 | AGGAUUAU C CAUGGGA | 167 | UCCCCAUG CUGAUGAGGCCGUUAGGCCGAA AUAAUCCU | 798 |
| 736 | UGGGGAAU U ACAUAGUC | 168 | GCCAUGU CUGAUGAGGCCGUUAGGCCGAA AUUCCCCA | 799 |
| 737 | GGGGAAUU A CAUAGGCC | 169 | GGCCUAUG CUGAUGAGGCCGUUAGGCCGAA AAUUCCCC | 800 |
| 741 | AAUUACAU A GGCCUUAU | 170 | AUAAGGCC CUGAUGAGGCCGUUAGGCCGAA AUGUAAUU | 801 |
| 747 | AUAGGCCU U AUCAAUAG | 171 | CUAUUGAU CUGAUGAGGCCGUUAGGCCGAA AGGCCUAU | 802 |
| 748 | UAGGCCUU A UCAAUAGA | 172 | UCUAUUGA CUGAUGAGGCCGUUAGGCCGAA AAGGCCUA | 803 |
| 750 | GGCCUUAU C AAUAGAAU | 173 | AUUCUAUU CUGAUGAGGCCGUUAGGCCGAA AUAAGGCC | 804 |
| 754 | UUAUCAAU A GAAUUGCC | 174 | GGCAAUUC CUGAUGAGGCCGUUAGGCCGAA AUUGAUAA | 805 |
| 759 | AAUAGAAU U GCCAGAA | 175 | UUCUGGGC CUGAUGAGGCCGUUAGGCCGAA AUUCUAUU | 806 |
| 777 | AAAAGACU A ACUGUAAA | 176 | UUUACAGU CUGAUGAGGCCGUUAGGCCGAA AGUCUUUU | 807 |
| 783 | CUAACUGU A AAUAUGA | 177 | UCAUAAUU CUGAUGAGGCCGUUAGGCCGAA ACAGUUAG | 808 |
| 787 | CUGUAAAU U AUGAACAG | 178 | CUGUUCAU CUGAUGAGGCCGUUAGGCCGAA AUUUACAG | 809 |
| 788 | UGUAAAUU A UGAACAGU | 179 | ACUGUUCA CUGAUGAGGCCGUUAGGCCGAA AAUUUACA | 810 |
| 803 | GUGUGCAU C GGGGGUGC | 180 | GCACCCCC CUGAUGAGGCCGUUAGGCCGAA AUGCACAC | 811 |
| 827 | AGAAGGAU U UCAUUAUA | 181 | UAUAAUGA CUGAUGAGGCCGUUAGGCCGAA AUCCUUCU | 812 |
| 828 | GAAGGAUU U CAUUAUAA | 182 | UUAUAAUG CUGAUGAGGCCGUUAGGCCGAA AAUCCUUC | 813 |
| 829 | AAGGAUUU C AUUAUAAA | 183 | UUUAUAAU CUGAUGAGGCCGUUAGGCCGAA AAAUCCUU | 814 |
| 832 | GAUUUCAU U AUAAAUGC | 184 | GCAUUUAU CUGAUGAGGCCGUUAGGCCGAA AUGAAAUC | 815 |
| 833 | AUUUCAUU A UAAAUGCA | 185 | UGCAUUUA CUGAUGAGGCCGUUAGGCCGAA AAUGAAAU | 816 |
| 835 | UUCAUUAU A AAUGCAAA | 186 | UUUGCAUU CUGAUGAGGCCGUUAGGCCGAA AUAAUGAA | 817 |
| 860 | GAAAGAAU A UAGUAUUG | 187 | CAAUACUA CUGAUGAGGCCGUUAGGCCGAA AUUCUUUC | 818 |
| 862 | AAGAGAUA U AGUAUUGGU | 188 | ACCAAUAC CUGAUGAGGCCGUUAGGCCGAA AUAUUCUU | 819 |
| 865 | AAUAUAGU A UUGGUACA | 189 | UGUACCAA CUGAUGAGGCCGUUAGGCCGAA ACUAUAUU | 820 |
| 867 | UAUAGUAU U GGUACAGG | 190 | CCUGUACC CUGAUGAGGCCGUUAGGCCGAA AUACUAUA | 821 |
| 871 | GUAUUGGU A CAGGUUCU | 191 | AGAACCUG CUGAUGAGGCCGUUAGGCCGAA ACCAAUAC | 822 |
| 877 | GUACAGGU U CUACUAAA | 192 | UUUAGUAG CUGAUGAGGCCGUUAGGCCGAA ACCUGUAC | 823 |
| 878 | UACAGGUU C UACUAAAC | 193 | GUUUAGUA CUGAUGAGGCCGUUAGGCCGAA AACCUGUA | 824 |
| 880 | CAGGUUCU A CUAAACAG | 194 | CUGUUUAG CUGAUGAGGCCGUUAGGCCGAA AGAACCUG | 825 |
| 883 | GUUCUACU A AACAGGAA | 195 | UUCCUGUU CUGAUGAGGCCGUUAGGCCGAA AGUAGAAC | 826 |
| 902 | AAAACGCU U GGCCGCUA | 196 | UAGCGGCC CUGAUGAGGCCGUUAGGCCGAA AUUGUUUU | 827 |
| 910 | UGGCCGCU A AACUUGCA | 197 | UGCAAGUU CUGAUGAGGCCGUUAGGCCGAA AGCGGCCA | 828 |
| 915 | GCUAAACU U GCAUAUCU | 198 | AGAUAUGC CUGAUGAGGCCGUUAGGCCGAA AGUUUAGC | 829 |
| 920 | ACUUGCAU A UCUUCAGA | 199 | UCUGAAGA CUGAUGAGGCCGUUAGGCCGAA AUGCAAGU | 830 |
| 922 | UUGCAUAU C UUCAGAUA | 200 | UAUCUGAA CUGAUGAGGCCGUUAGGCCGAA AUAUGCAA | 831 |
| 924 | GCAUAUCU U CAGAUAUU | 201 | AAUAUCUG CUGAUGAGGCCGUUAGGCCGAA AGAUAUGC | 832 |
| 925 | CAUAUCUU C AGAUAUUA | 202 | UAAUAUCU CUGAUGAGGCCGUUAGGCCGAA AAGAUAUG | 833 |
| 930 | CUUCAGAU A UUAUCAGA | 203 | UCUGAUAA CUGAUGAGGCCGUUAGGCCGAA AUCUGAAG | 834 |
| 932 | UCAGAUAU U AUCAGAAG | 204 | CUUCUGAU CUGAUGAGGCCGUUAGGCCGAA AUAUCUGA | 835 |
| 933 | CAGAUAUU A UCAGAAGA | 205 | UCUUCUGA CUGAUGAGGCCGUUAGGCCGAA AAUAUCUG | 836 |
| 935 | GAUAUUAU C AGAAGAAA | 206 | UUUCUUCU CUGAUGAGGCCGUUAGGCCGAA AUAAUAUC | 837 |
| 947 | AGAAACCU C AGUGAAAU | 207 | AUUUCACU CUGAUGAGGCCGUUAGGCCGAA AGGUUUCU | 838 |

TABLE VIII-continued

Human PKR Hammerhead and Substrate Sequence

| Pos | Substrate | Seq ID | Hammerhead | Seq ID |
|---|---|---|---|---|
| 956 | AGUGAAAU C UGACUACC | 208 | GGUAGUCA CUGAUGAGGCCGUUAGGCCGAA AUUUCACU | 839 |
| 962 | AUCUGACU A CCUGUCCU | 209 | AGGACAGG CUGAUGAGGCCGUUAGGCCGAA AGUCAGAU | 840 |
| 968 | CUACCUGU C CUCUGGUU | 210 | AACCAGAG CUGAUGAGGCCGUUAGGCCGAA ACAGGUAG | 841 |
| 971 | CCUGUCCU C UGGUUCUU | 211 | AAGAACCA CUGAUGAGGCCGUUAGGCCGAA AGGACAGG | 842 |
| 976 | CCUCUGGU U CUUUUGCU | 212 | AGCAAAAG CUGAUGAGGCCGUUAGGCCGAA ACCAGAGG | 843 |
| 977 | CUCUGGUU C UUUUGCUA | 213 | UAGCAAAA CUGAUGAGGCCGUUAGGCCGAA AACCAGAG | 844 |
| 979 | CUGGUUCU U UUGCUACU | 214 | AGUAGCAA CUGAUGAGGCCGUUAGGCCGAA AGAACCAG | 845 |
| 980 | UGGUUCUU U UGCUACUA | 215 | UAGUAGCA CUGAUGAGGCCGUUAGGCCGAA AAGAACCA | 846 |
| 981 | GGUUCUUU U GCUACUAC | 216 | GUAGUAGC CUGAUGAGGCCGUUAGGCCGAA AAAGAACC | 847 |
| 985 | CUUUUGCU A CUACGUGU | 217 | ACACGUAG CUGAUGAGGCCGUUAGGCCGAA AGCAAAAG | 848 |
| 988 | UUGCUACU A CGUGUGAG | 218 | CUCACACG CUGAUGAGGCCGUUAGGCCGAA AGUAGCAA | 849 |
| 998 | GUGUGAGU C CCAAAGCA | 219 | UGCUUUGG CUGAUGAGGCCGUUAGGCCGAA ACUCACAC | 850 |
| 1010 | AAGCAACU C UUUAGUGA | 220 | UCACUAAA CUGAUGAGGCCGUUAGGCCGAA AGUUGCUU | 851 |
| 1012 | GCAACUCU U UAGUGACC | 221 | GGUCACUA CUGAUGAGGCCGUUAGGCCGAA AGAGUUGC | 852 |
| 1013 | CAACUCUU U AGUGACCA | 222 | UGGUCACU CUGAUGAGGCCGUUAGGCCGAA AAGAGUUG | 853 |
| 1014 | AACUCUUU A GUGACCAG | 223 | CUGGUCAC CUGAUGAGGCCGUUAGGCCGAA AAAGAGUU | 854 |
| 1029 | AGCACACU C GCUUCUGA | 224 | UCAGAAGC CUGAUGAGGCCGUUAGGCCGAA AGUGUGCU | 855 |
| 1033 | CACUCGCU U CUGAAUCA | 225 | UGAUUCAG CUGAUGAGGCCGUUAGGCCGAA AGCGAGUG | 856 |
| 1034 | ACUCGCUU C UGAAUCAU | 226 | AUGAUUCA CUGAUGAGGCCGUUAGGCCGAA AAGCGAGU | 857 |
| 1040 | UUCUGAAU C AUCAUCUG | 227 | CAGAUGAU CUGAUGAGGCCGUUAGGCCGAA AUUCAGAA | 858 |
| 1043 | UGAAUCAU C AUCUGAAG | 228 | CUUCAGAU CUGAUGAGGCCGUUAGGCCGAA AUGAUUCA | 859 |
| 1046 | AUCAUCAU C UGAGGUG | 229 | CACCUUCA CUGAUGAGGCCGUUAGGCCGAA AUGAUGAU | 860 |
| 1058 | AGGUGACU U CUCAGCAG | 230 | CUGCUGAG CUGAUGAGGCCGUUAGGCCGAA AGUCACCU | 861 |
| 1059 | GGUGACUU C UCAGCAGA | 231 | UCUGCUGA CUGAUGAGGCCGUUAGGCCGAA AAGUCACC | 862 |
| 1061 | UGACUUCU C AGCAGAUA | 232 | UAUCUGCU CUGAUGAGGCCGUUAGGCCGAA AGAAGUCA | 863 |
| 1069 | CAGCAGAU A CAUCAGAG | 233 | CUCUGAUG CUGAUGAGGCCGUUAGGCCGAA AUCUGCUG | 864 |
| 1073 | AGAUACAU C AGAGAUAA | 234 | UUAUCUCU CUGAUGAGGCCGUUAGGCCGAA AUGUAUCU | 865 |
| 1080 | UCAGAGAU A AAUUCUAA | 235 | UUAGAAUU CUGAUGAGGCCGUUAGGCCGAA AUCUCUGA | 866 |
| 1084 | AGAUAAAU U CUAACAGU | 236 | ACUGUUAG CUGAUGAGGCCGUUAGGCCGAA AUUUAUCU | 867 |
| 1085 | GAUAAAUU C UAACAGUG | 237 | CACUGUUA CUGAUGAGGCCGUUAGGCCGAA AAUUUAUC | 868 |
| 1087 | UAAAUUCU A ACAGUGAC | 238 | GUCACUGU CUGAUGAGGCCGUUAGGCCGAA AGAAUUUA | 869 |
| 1099 | GUGACAGU U UAAACAGU | 239 | ACUGUUUA CUGAUGAGGCCGUUAGGCCGAA ACUGUCAC | 870 |
| 1100 | UGACAGUU U AAACAGUU | 240 | AACUGUUU CUGAUGAGGCCGUUAGGCCGAA AACUGUCA | 871 |
| 1101 | GACAGUUU A AACAGUUC | 241 | GAACUGUU CUGAUGAGGCCGUUAGGCCGAA AAACUGUC | 872 |
| 1108 | UAAACAGU U CUUCGUUG | 242 | CAACGAAG CUGAUGAGGCCGUUAGGCCGAA ACUGUUUA | 873 |
| 1109 | AAACAGUU C UUCGUUGC | 243 | GCAACGAA CUGAUGAGGCCGUUAGGCCGAA AACUGUUU | 874 |
| 1111 | ACAGUUCU U CGUUGCUU | 244 | AAGCAACG CUGAUGAGGCCGUUAGGCCGAA AGAACUGU | 875 |
| 1112 | CAGUUCUU C GUUGCUUA | 245 | UAAGCAAC CUGAUGAGGCCGUUAGGCCGAA AAGAACUG | 876 |
| 1115 | UUCUUCGU U GCUUAUGA | 246 | UCAUAAGC CUGAUGAGGCCGUUAGGCCGAA ACGAAGAA | 877 |
| 1119 | UCGUUGCU U AUGAAUGG | 247 | CCAUUCAU CUGAUGAGGCCGUUAGGCCGAA AGCAACGA | 878 |
| 1120 | CGUUGCUU A UGAAUGGU | 248 | ACCAUUCA CUGAUGAGGCCGUUAGGCCGAA AAGCAACG | 879 |
| 1129 | UGAAUGGU C UCAGAAAU | 249 | AUUUCUGA CUGAUGAGGCCGUUAGGCCGAA ACCAUUCA | 880 |
| 1131 | AAUGGUCU C AGAAAUAA | 250 | UUAUUUCU CUGAUGAGGCCGUUAGGCCGAA AGACCAUU | 881 |
| 1138 | UCAGAAAU A AUCAAAGG | 251 | CCUUUGAU CUGAUGAGGCCGUUAGGCCGAA AUUUCUGA | 882 |
| 1141 | GAAAUAAU C AAAGGAAG | 252 | CUUCCUUU CUGAUGAGGCCGUUAGGCCGAA AUUAUUUC | 883 |
| 1160 | AAAAAGAU C UUUGGCAC | 253 | GUGCCAAA CUGAUGAGGCCGUUAGGCCGAA AUCUUUUU | 884 |
| 1162 | AAAGAUCU U UGGCACCC | 254 | GGGUGCCA CUGAUGAGGCCGUUAGGCCGAA AGAUCUUU | 885 |
| 1163 | AAGAUCUU U GGCACCCA | 255 | UGGGUGCC CUGAUGAGGCCGUUAGGCCGAA AAGAUCUU | 886 |
| 1175 | ACCCAGAU U UGACCUUC | 256 | GAAGGUCA CUGAUGAGGCCGUUAGGCCGAA AUCUGGGU | 887 |
| 1176 | CCCAGAUU U GACCUUCC | 257 | GGAAGGUC CUGAUGAGGCCGUUAGGCCGAA AAUCUGGG | 888 |
| 1182 | UUUGACCU U CCUGACAU | 258 | AUGUCAGG CUGAUGAGGCCGUUAGGCCGAA AGGUCAAA | 889 |
| 1183 | UUGACCUU C CUGACAUG | 259 | CAUGUCAG CUGAUGAGGCCGUUAGGCCGAA AAGGUCAA | 890 |
| 1205 | AACAAGU A UACUGUGG | 260 | CCACAGUA CUGAUGAGGCCGUUAGGCCGAA ACUUGUU | 891 |
| 1207 | CAAAGUAU A CUGUGGAC | 261 | GUCCACAG CUGAUGAGGCCGUUAGGCCGAA AUACUUUG | 892 |
| 1223 | CAAGAGGU U UGGCAUGG | 262 | CCAUGCCA CUGAUGAGGCCGUUAGGCCGAA ACCUCUUG | 893 |
| 1224 | AAGAGGUU U GGCAUGGA | 263 | UCCAUGCC CUGAUGAGGCCGUUAGGCCGAA AACCUCUU | 894 |
| 1234 | GCAUGGAU U UUAAAGAA | 264 | UUCUUUAA CUGAUGAGGCCGUUAGGCCGAA AUCCAUGC | 895 |
| 1235 | CAUGGAUU U UAAAGAAA | 265 | UUUCUUUA CUGAUGAGGCCGUUAGGCCGAA AAUCCAUG | 896 |
| 1236 | AUGGAUUU U AAAGAAAU | 266 | AUUUCUUU CUGAUGAGGCCGUUAGGCCGAA AAAUCCAU | 897 |
| 1237 | UGGAUUUU A AAGAAAUA | 267 | UAUUUCUU CUGAUGAGGCCGUUAGGCCGAA AAAAUCCA | 898 |
| 1245 | AAAGAAAU A GAAUUAAU | 268 | AUUAAUUC CUGAUGAGGCCGUUAGGCCGAA AUUUCUUU | 899 |
| 1250 | AAUAGAAU U AAUGGCU | 269 | AGCCAAUU CUGAUGAGGCCGUUAGGCCGAA AUUCUAUU | 900 |
| 1251 | AUAGAAUU A AUUGGCUC | 270 | GAGCCAAU CUGAUGAGGCCGUUAGGCCGAA AAUUCUAU | 901 |
| 1254 | GAAUUAAU U GGCUCAGG | 271 | CCUGAGCC CUGAUGAGGCCGUUAGGCCGAA AUUAAUUC | 902 |
| 1259 | AAUUGGCU C AGGUGGAU | 272 | AUCCACCU CUGAUGAGGCCGUUAGGCCGAA AGCCAAUU | 903 |
| 1268 | AGGUGGAU U UGGCCAAG | 273 | CUUGGCCA CUGAUGAGGCCGUUAGGCCGAA AUCCACCU | 904 |
| 1269 | GGUGGAUU U GGCCAAGU | 274 | ACUUGGCC CUGAUGAGGCCGUUAGGCCGAA AAUCCACC | 905 |
| 1278 | GGCCAAGU U UCAAAGC | 275 | GCUUUGAA CUGAUGAGGCCGUUAGGCCGAA ACUUGGCC | 906 |
| 1279 | GCCAAGUU U CAAAGCA | 276 | UGCUUUGA CUGAUGAGGCCGUUAGGCCGAA AACUUGGC | 907 |
| 1280 | CCAAGUUU U CAAAGCAA | 277 | UUGCUUUG CUGAUGAGGCCGUUAGGCCGAA AAACUUGG | 908 |
| 1281 | CAAGUUUU C AAAGCAAA | 278 | UUUGCUUU CUGAUGAGGCCGUUAGGCCGAA AAAACUUG | 909 |
| 1299 | CACAGAAU U GACGGAAA | 279 | UUUCCGUC CUGAUGAGGCCGUUAGGCCGAA AUUCUGUG | 910 |
| 1312 | GAAAGACU U ACGUUAUU | 280 | AAUAACGU CUGAUGAGGCCGUUAGGCCGAA AGUCUUUC | 911 |
| 1313 | AAAGACUU A CGUUAUUA | 281 | UAAUAACG CUGAUGAGGCCGUUAGGCCGAA AAGUCUUU | 912 |
| 1317 | ACUUACGU U AUUAAACG | 282 | CGUUUAAU CUGAUGAGGCCGUUAGGCCGAA ACGUAAGU | 913 |

TABLE VIII-continued

Human PKR Hammerhead and Substrate Sequence

| Pos | Substrate | Seq ID | Hammerhead | Seq ID |
|---|---|---|---|---|
| 1318 | CUUACGUU A UUAAACGU | 283 | ACGUUUAA CUGAUGAGGCCGUUAGGCCGAA AACGUAAG | 914 |
| 1320 | UACGUUAU U AAACGUGU | 284 | ACACGUUU CUGAUGAGGCCGUUAGGCCGAA AUAACGUA | 915 |
| 1321 | ACGUUAUU A AACGUGUU | 285 | AACACGUU CUGAUGAGGCCGUUAGGCCGAA AAUAACGU | 916 |
| 1329 | AAACGUGU U AAAUAUAA | 286 | UUAUAUUU CUGAUGAGGCCGUUAGGCCGAA ACACGUUU | 917 |
| 1330 | AACGUGUU A AAUAUAAU | 287 | AUUAUAUU CUGAUGAGGCCGUUAGGCCGAA AACACGUU | 918 |
| 1334 | UGUUAAAU A UAAUAACG | 288 | CGUUAUUA CUGAUGAGGCCGUUAGGCCGAA AUUUAACA | 919 |
| 1336 | UUAAAUAU A AUAACGAG | 289 | CUCGUUAU CUGAUGAGGCCGUUAGGCCGAA AUAUUUAA | 920 |
| 1339 | AAUAUAAU A ACGAGAAG | 290 | CUUCUCGU CUGAUGAGGCCGUUAGGCCGAA AUUAUAUU | 921 |
| 1362 | CGUGAAGU A AAAGCAUU | 291 | AAUGCUUU CUGAUGAGGCCGUUAGGCCGAA ACUUCACG | 922 |
| 1370 | AAAAGCAU U GGCAAAAC | 292 | GUUUUGCC CUGAUGAGGCCGUUAGGCCGAA AUGCUUUU | 923 |
| 1380 | GCAAAACU U GAUCAUGU | 293 | ACAUGAUC CUGAUGAGGCCGUUAGGCCGAA AGUUUUGC | 924 |
| 1384 | AACUUGAU C AUGUAAAU | 294 | AUUUACAU CUGAUGAGGCCGUUAGGCCGAA AUCAAGUU | 925 |
| 1389 | GAUCAUGU A AAUAUUGU | 295 | ACAAUAUU CUGAUGAGGCCGUUAGGCCGAA ACAUGAUC | 926 |
| 1393 | AUGUAAAU A UUGUUCAC | 296 | GUGAACAA CUGAUGAGGCCGUUAGGCCGAA AUUUACAU | 927 |
| 1395 | GUAAAUAU U GUUCACUA | 297 | UAGUGAAC CUGAUGAGGCCGUUAGGCCGAA AUAUUUAC | 928 |
| 1398 | AAUAUUGU U CACUACAA | 298 | UUGUAGUG CUGAUGAGGCCGUUAGGCCGAA ACAAUAUU | 929 |
| 1399 | AUAUUGUU C ACUACAAU | 299 | AUUGUAGU CUGAUGAGGCCGUUAGGCCGAA AACAAUAU | 930 |
| 1403 | UGUUCACU A CAAUGGCU | 300 | AGCCAUUG CUGAUGAGGCCGUUAGGCCGAA AGUGAACA | 931 |
| 1414 | AUGGCUGU U GGGAUGGA | 301 | UCCAUCCC CUGAUGAGGCCGUUAGGCCGAA ACAGCCAU | 932 |
| 1424 | GGAUGGAU U UGAUUAUG | 302 | CAUAAUCA CUGAUGAGGCCGUUAGGCCGAA AUCCAUCC | 933 |
| 1425 | GAUGGAUU U GAUUAUGA | 303 | UCAUAAUC CUGAUGAGGCCGUUAGGCCGAA AAUCCAUC | 934 |
| 1429 | GAUUUGAU U AUGAUCCU | 304 | AGGAUCAU CUGAUGAGGCCGUUAGGCCGAA AUCAAAUC | 935 |
| 1430 | AUUUGAUU A UGAUCCUG | 305 | CAGGAUCA CUGAUGAGGCCGUUAGGCCGAA AAUCAAAU | 936 |
| 1435 | AUUAUGAU C CUGAGACC | 306 | GGUCUCAG CUGAUGAGGCCGUUAGGCCGAA AUCAUAAU | 937 |
| 1453 | GUGAUGAU U CUCUUGAG | 307 | CUCAAGAG CUGAUGAGGCCGUUAGGCCGAA AUCAUCAC | 938 |
| 1454 | UGAUGAUU C UCUUGAGA | 308 | UCUCAAGA CUGAUGAGGCCGUUAGGCCGAA AAUCAUCA | 939 |
| 1456 | AUGAUUCU C UUGAGAGC | 309 | GCUCUCAA CUGAUGAGGCCGUUAGGCCGAA AGAAUCAU | 940 |
| 1458 | GAUUCUCU U GAGAGCAG | 310 | CUGCUCUC CUGAUGAGGCCGUUAGGCCGAA AGAGAAUC | 941 |
| 1471 | GCAGUGAU A UGAUCCU | 311 | AGGAUCAU CUGAUGAGGCCGUUAGGCCGAA AUCACUGC | 942 |
| 1472 | CAGUGAUU A UGAUCCUG | 312 | CAGGAUCA CUGAUGAGGCCGUUAGGCCGAA AAUCACUG | 943 |
| 1477 | AUUAUGAU C UGAGAAC | 313 | GUUCUCAG CUGAUGAGGCCGUUAGGCCGAA AUCAUAAU | 944 |
| 1495 | GCAAAAAU A GUUCAAGG | 314 | CCUUGAAC CUGAUGAGGCCGUUAGGCCGAA AUUUUUGC | 945 |
| 1498 | AAAAUAGU U CAAGGUCA | 315 | UGACCUUG CUGAUGAGGCCGUUAGGCCGAA ACUAUUUU | 946 |
| 1499 | AAAUAGUU C AAGGUCAA | 316 | UUGACCUU CUGAUGAGGCCGUUAGGCCGAA AACUAUUU | 947 |
| 1505 | UUCAAGGU C AAAGACUA | 317 | UAGUCUUU CUGAUGAGGCCGUUAGGCCGAA ACCUUGAA | 948 |
| 1513 | CAAAGACU A AGUGCCUU | 318 | AAGGCACU CUGAUGAGGCCGUUAGGCCGAA AGUCUUUG | 949 |
| 1521 | AAGUGCCU U UUCAUCCA | 319 | UGGAUGAA CUGAUGAGGCCGUUAGGCCGAA AGGCACUU | 950 |
| 1522 | AGUGCCUU U UCAUCCAA | 320 | UUGGAUGA CUGAUGAGGCCGUUAGGCCGAA AAGGCACU | 951 |
| 1523 | GUGCCUUU U CAUCCAAA | 321 | UUUGGAUG CUGAUGAGGCCGUUAGGCCGAA AAAGGCAC | 952 |
| 1524 | UGCCUUUU C AUCCAAAU | 322 | AUUUGGAU CUGAUGAGGCCGUUAGGCCGAA AAAAGGCA | 953 |
| 1527 | CUUUUCAU C CAAAUGGA | 323 | UCCAUUUG CUGAUGAGGCCGUUAGGCCGAA AUGAAAAG | 954 |
| 1538 | AAUGGAAU U CUGUGAUA | 324 | UAUCACAG CUGAUGAGGCCGUUAGGCCGAA AUUCCAUU | 955 |
| 1539 | AUGGAAUU C UGUGAUAA | 325 | UUAUCACA CUGAUGAGGCCGUUAGGCCGAA AAUUCCAU | 956 |
| 1546 | UCUGUGAU A AGGGACC | 326 | GGUCCCUU CUGAUGAGGCCGUUAGGCCGAA AUCACAGA | 957 |
| 1556 | AGGGACCU U GGAACAAU | 327 | AUUGUUCC CUGAUGAGGCCGUUAGGCCGAA AGGUCCCU | 958 |
| 1569 | CAAUGGAU U GAAAAAAG | 328 | CUUUUUUC CUGAUGAGGCCGUUAGGCCGAA AUCCAUUG | 959 |
| 1593 | GAGAAACU A GACAAAGU | 329 | ACUUUGUC CUGAUGAGGCCGUUAGGCCGAA AGUUUCUC | 960 |
| 1602 | GACAAAGU U UGGCUUUU | 330 | AAAGCCAA CUGAUGAGGCCGUUAGGCCGAA ACUUUGUC | 961 |
| 1603 | ACAAAGUU U GGCUUUGG | 331 | CAAAGCCA CUGAUGAGGCCGUUAGGCCGAA AACUUUGU | 962 |
| 1604 | CAAAGUUU U GGCUUUGG | 332 | CCAAAGCC CUGAUGAGGCCGUUAGGCCGAA AAACUUUG | 963 |
| 1609 | UUUUGGCU U UGGAACUC | 333 | GAGUUCCA CUGAUGAGGCCGUUAGGCCGAA AGCCAAAA | 964 |
| 1610 | UUUGGCUU U GGAACUCU | 334 | AGAGUUCC CUGAUGAGGCCGUUAGGCCGAA AAGCCAAA | 965 |
| 1617 | UUGGAACU C UUUGAACA | 335 | UGUUCAAA CUGAUGAGGCCGUUAGGCCGAA AGUUCCAA | 966 |
| 1619 | GGAACUCU U UGAACAAA | 336 | UUUGUUCA CUGAUGAGGCCGUUAGGCCGAA AGAGUUCC | 967 |
| 1620 | GAACUCUU U GAACAAAU | 337 | AUUUGUUC CUGAUGAGGCCGUUAGGCCGAA AAGAGUUC | 968 |
| 1629 | GAACAAAU A ACAAAAGG | 338 | CCUUUUGU CUGAUGAGGCCGUUAGGCCGAA AUUUGUUC | 969 |
| 1645 | GGGUGGAU U AUAUACAU | 339 | AUGUAUAU CUGAUGAGGCCGUUAGGCCGAA AUCCACCC | 970 |
| 1646 | GGUGGAUU A UAUACAUU | 340 | AAUGUAUA CUGAUGAGGCCGUUAGGCCGAA AAUCCACC | 971 |
| 1648 | UGGAUUAU A UACAUUCA | 341 | UGAAUGUA CUGAUGAGGCCGUUAGGCCGAA AUAAUCCA | 972 |
| 1650 | GAUUAUAU A CAUUCAAA | 342 | UUUGAAUG CUGAUGAGGCCGUUAGGCCGAA AUAUAAUC | 973 |
| 1654 | AUAUACAU U CAAAAAAA | 343 | UUUUUUUG CUGAUGAGGCCGUUAGGCCGAA AUGUAUAU | 974 |
| 1655 | UAUACAUU C AAAAAAAU | 344 | AUUUUUUU CUGAUGAGGCCGUUAGGCCGAA AAUGUAUA | 975 |
| 1664 | AAAAAAAU U AAUUCAUA | 345 | UAUGAAUU CUGAUGAGGCCGUUAGGCCGAA AUUUUUUU | 976 |
| 1665 | AAAAAAUU A AUUCAUAG | 346 | CUAUGAAU CUGAUGAGGCCGUUAGGCCGAA AAUUUUUU | 977 |
| 1668 | AAAUUAAU U CAUAGAGA | 347 | UCUCUAUG CUGAUGAGGCCGUUAGGCCGAA AUUAAUUU | 978 |
| 1669 | AAUUAAUU C AUAGAGAU | 348 | AUCUCUAU CUGAUGAGGCCGUUAGGCCGAA AAUUAAUU | 979 |
| 1672 | UAAUUCAU A GAGAUCUU | 349 | AAGAUCUC CUGAUGAGGCCGUUAGGCCGAA AUGAAUUA | 980 |
| 1678 | AUAGAGAU C UUAGCCA | 350 | UGGCUUAA CUGAUGAGGCCGUUAGGCCGAA AUCUCUAU | 981 |
| 1680 | AGAGAUCU U AAGCCAAG | 351 | CUUGGCUU CUGAUGAGGCCGUUAGGCCGAA AGAUCUCU | 982 |
| 1681 | GAGAUCUU A AGCCAAGU | 352 | ACUUGGCU CUGAUGAGGCCGUUAGGCCGAA AAGAUCUC | 983 |
| 1690 | AGCCAAGU A AUAUAUUC | 353 | GAAUAUAU CUGAUGAGGCCGUUAGGCCGAA ACUUGGCU | 984 |
| 1693 | CAAGUAAU A UAUUCUUA | 354 | UAAGAAUA CUGAUGAGGCCGUUAGGCCGAA AUUACUUG | 985 |
| 1695 | AGUAAUAU A UUCUUACU | 355 | ACUAAGAA CUGAUGAGGCCGUUAGGCCGAA AUAUUACU | 986 |
| 1697 | UAAUAUAU U CUUAGUAG | 356 | CUACUAAG CUGAUGAGGCCGUUAGGCCGAA AUAUAUUA | 987 |
| 1698 | AAUAUAUU C UUAGUAGA | 357 | UCUACUAA CUGAUGAGGCCGUUAGGCCGAA AAUAUAUU | 988 |

TABLE VIII-continued

Human PKR Hammerhead and Substrate Sequence

| Pos | Substrate | Seq ID | Hammerhead | Seq ID |
|---|---|---|---|---|
| 1700 | UAUAUUCU U AGUAGAUA | 358 | UAUCUACU CUGAUGAGGCCGUUAGGCCGAA AGAAUAUA | 989 |
| 1701 | AUAUUCUU A GUAGAUAC | 359 | GUAUCUAC CUGAUGAGGCCGUUAGGCCGAA AAGAAUAU | 990 |
| 1704 | UUCUAGU A GAUACAAA | 360 | UUUGUAUC CUGAUGAGGCCGUUAGGCCGAA ACUAAGAA | 991 |
| 1708 | UAGUAGAU A CAAAACAA | 361 | UUGUUUUG CUGAUGAGGCCGUUAGGCCGAA AUCUACUA | 992 |
| 1719 | AAACAAGU A AAGAUUGG | 362 | CCAAUCUU CUGAUGAGGCCGUUAGGCCGAA ACUUGUUU | 993 |
| 1725 | GUAAAGU U GGACACUU | 363 | AAGUCUCC CUGAUGAGGCCGUUAGGCCGAA AUCUUUAC | 994 |
| 1733 | UGGACACU U UGGACUUG | 364 | CAAGUCCA CUGAUGAGGCCGUUAGGCCGAA AGUCUCCA | 995 |
| 1734 | GGAGACUU U GGACUUGU | 365 | ACAAGUCC CUGAUGAGGCCGUUAGGCCGAA AAGUCUCC | 996 |
| 1740 | UUUGGACU U GUAACAUC | 366 | GAUGUUAC CUGAUGAGGCCGUUAGGCCGAA AGUCCAAA | 997 |
| 1743 | GGACUUGU A ACAUCUCU | 367 | AGAGAUGU CUGAUGAGGCCGUUAGGCCGAA ACAAGUCC | 998 |
| 1748 | UGUAACAU C UCUGAAAA | 368 | UUUUCAGA CUGAUGAGGCCGUUAGGCCGAA AUGUUACA | 999 |
| 1750 | UAACAUCU C UGAAAAAU | 369 | AUUUUUCA CUGAUGAGGCCGUUAGGCCGAA AGAUGUUA | 1000 |
| 1780 | CAAGGAGU A AGGGAACU | 370 | AGUUCCCU CUGAUGAGGCCGUUAGGCCGAA ACUCCUUG | 1001 |
| 1789 | AGGGAACU U UGCGAUAC | 371 | GUAUCGCA CUGAUGAGGCCGUUAGGCCGAA AGUUCCCU | 1002 |
| 1790 | GGGAACUU U GCGAUACA | 372 | UGUAUCGC CUGAUGAGGCCGUUAGGCCGAA AAGUUCCC | 1003 |
| 1796 | UUUGCGAU A CAUGAGCC | 373 | GGCUCAUG CUGAUGAGGCCGUUAGGCCGAA AUCGCAAA | 1004 |
| 1815 | GAACAGAU U UCUUCGCA | 374 | UGCGAAGA CUGAUGAGGCCGUUAGGCCGAA AUCUGUUC | 1005 |
| 1816 | AACAGAUU U CUUCGCAA | 375 | UUGCGAAG CUGAUGAGGCCGUUAGGCCGAA AAUCUGUU | 1006 |
| 1817 | ACAGAUUU C UUCGCAAG | 376 | CUUGCGAA CUGAUGAGGCCGUUAGGCCGAA AAAUCUGU | 1007 |
| 1819 | AGAUUUCU U CGCAAGAC | 377 | GUCUUGCG CUGAUGAGGCCGUUAGGCCGAA AGAAAUCU | 1008 |
| 1820 | GAUUUCUU C GCAAGACU | 378 | AGUCUUGC CUGAUGAGGCCGUUAGGCCGAA AAGAAAUC | 1009 |
| 1829 | GCAAGACU A UGGAAAGG | 379 | CCUUUCCA CUGAUGAGGCCGUUAGGCCGAA AGUCUUGC | 1010 |
| 1848 | GUGGACCU C UACGCUUU | 380 | AAAGCGUA CUGAUGAGGCCGUUAGGCCGAA AGGUCCAC | 1011 |
| 1850 | GGACCUCU A CGCUUUGG | 381 | CCAAAGCG CUGAUGAGGCCGUUAGGCCGAA AGAGGUCC | 1012 |
| 1855 | UCUACGCU U UGGGCUA | 382 | UAGCCCCA CUGAUGAGGCCGUUAGGCCGAA AGCGUAGA | 1013 |
| 1856 | CUACGCUU U GGGGCUAA | 383 | UUAGCCCC CUGAUGAGGCCGUUAGGCCGAA AAGCGUAG | 1014 |
| 1863 | UUGGGCU A AUUCUUGC | 384 | GCAAGAAU CUGAUGAGGCCGUUAGGCCGAA AGCCCCAA | 1015 |
| 1866 | GGGCUAAU U CUUGCUGA | 385 | UCAGCAAG CUGAUGAGGCCGUUAGGCCGAA AUUAGCCC | 1016 |
| 1867 | GGCUAAUU C UUGCUGAA | 386 | UUCAGCAA CUGAUGAGGCCGUUAGGCCGAA AAUUAGCC | 1017 |
| 1869 | CUAAUUCU U GCUGAACU | 387 | AGUUCAGC CUGAUGAGGCCGUUAGGCCGAA AGAAUUAG | 1018 |
| 1878 | GCUGAACU U CUUCAUGU | 388 | ACAUGAAG CUGAUGAGGCCGUUAGGCCGAA AGUUCAGC | 1019 |
| 1879 | CUGAACUU C UUCAUGUA | 389 | UACAUGAA CUGAUGAGGCCGUUAGGCCGAA AAGUUCAG | 1020 |
| 1881 | GAACUUCU U CAUGUAUG | 390 | CAUACAUG CUGAUGAGGCCGUUAGGCCGAA AGAAGUUC | 1021 |
| 1882 | AACUUCUU C AUGUAUGU | 391 | ACAUACAU CUGAUGAGGCCGUUAGGCCGAA AAGAAGUU | 1022 |
| 1887 | CUUCAUGU A UGUGACAC | 392 | GUGUCACA CUGAUGAGGCCGUUAGGCCGAA ACAUGAAG | 1023 |
| 1900 | ACACGCU U UUGAAACA | 393 | UGUUUCAA CUGAUGAGGCCGUUAGGCCGAA AGCAGUGU | 1024 |
| 1901 | CACUGCUU U UGAAACAU | 394 | AUGUUUCA CUGAUGAGGCCGUUAGGCCGAA AAGCAGUG | 1025 |
| 1902 | ACUGCUUU U GAAACAUC | 395 | GAUGUUUC CUGAUGAGGCCGUUAGGCCGAA AAAGCAGU | 1026 |
| 1910 | UGAAACAU C AAAGUUUU | 396 | AAAACUUU CUGAUGAGGCCGUUAGGCCGAA AUGUUUCA | 1027 |
| 1916 | AUCAAAGU U UUUCACAG | 397 | CUGUGAAA CUGAUGAGGCCGUUAGGCCGAA ACUUUGAU | 1028 |
| 1917 | UCAAAGUU U UUCACAGA | 398 | UCUGUGAA CUGAUGAGGCCGUUAGGCCGAA AACUUUGA | 1029 |
| 1918 | CAAAGUUU U UCACAGAC | 399 | GUCUGUGA CUGAUGAGGCCGUUAGGCCGAA AAACUUUG | 1030 |
| 1919 | AAAGUUUU U CACAGACC | 400 | GGUCUGUG CUGAUGAGGCCGUUAGGCCGAA AAAACUUU | 1031 |
| 1920 | AAGUUUUU C ACAGACCU | 401 | AGGUCUGU CUGAUGAGGCCGUUAGGCCGAA AAAAACUU | 1032 |
| 1929 | ACAGACCU A CGGGAUGG | 402 | CCAUCCCG CUGAUGAGGCCGUUAGGCCGAA AGGUCUGU | 1033 |
| 1941 | GAUGGCAU C AUCUCAGA | 403 | UCUGAGAU CUGAUGAGGCCGUUAGGCCGAA AUGCCAUC | 1034 |
| 1944 | GGCAUCAU C UCAGAUAU | 404 | AUAUCUGA CUGAUGAGGCCGUUAGGCCGAA AUGAUGCC | 1035 |
| 1946 | CAUCUCU C AGAUAUAU | 405 | AUAUAUCU CUGAUGAGGCCGUUAGGCCGAA AGAUGAUG | 1036 |
| 1951 | UCUCAGAU A UAUUUGAU | 406 | AUCAAAUA CUGAUGAGGCCGUUAGGCCGAA AUCUGAGA | 1037 |
| 1953 | UCAGAUAU A UUUGAUAA | 407 | UUAUCAAA CUGAUGAGGCCGUUAGGCCGAA AUAUCUGA | 1038 |
| 1955 | AGAUAUAU U UGAUAAAA | 408 | UUUUAUCA CUGAUGAGGCCGUUAGGCCGAA AUAUAUCU | 1039 |
| 1956 | GAUAUAUU U GAUAAAAA | 409 | UUUUUAUC CUGAUGAGGCCGUUAGGCCGAA AAUAUAUC | 1040 |
| 1960 | UAUUUGAU A AAAAGAA | 410 | UUCUUUUU CUGAUGAGGCCGUUAGGCCGAA AUCAAAUA | 1041 |
| 1975 | AAAAACU U UCUACAG | 411 | CUGUAGAA CUGAUGAGGCCGUUAGGCCGAA AGUUUUUU | 1042 |
| 1977 | AAACUCU U CUACAGAA | 412 | UUCUGUAG CUGAUGAGGCCGUUAGGCCGAA AGAGUUUU | 1043 |
| 1978 | AAACUCUU C UACAGAAA | 413 | UUUCUGUA CUGAUGAGGCCGUUAGGCCGAA AAGAGUUU | 1044 |
| 1980 | ACUCUUCU A CAGAAAUU | 414 | AAUUUCUG CUGAUGAGGCCGUUAGGCCGAA AGAAGAGU | 1045 |
| 1988 | ACAGAAU U ACUCUCAA | 415 | UUGAGAGU CUGAUGAGGCCGUUAGGCCGAA AUUUCUGU | 1046 |
| 1989 | CAGAAAUU A CUCUCAAA | 416 | UUUGAGAG CUGAUGAGGCCGUUAGGCCGAA AAUUUCUG | 1047 |
| 1992 | AAAUUACU C UCAAGAA | 417 | UUCUUGA CUGAUGAGGCCGUUAGGCCGAA AGUAAUUU | 1048 |
| 1994 | AUUACUCU C AAAGAAAC | 418 | GUUUCUUU CUGAUGAGGCCGUUAGGCCGAA AGAGUAAU | 1049 |
| 2011 | CUGAGGAU C GACCUAAC | 419 | GUUAGGUC CUGAUGAGGCCGUUAGGCCGAA AUCCUCAG | 1050 |
| 2017 | AUCGACCU A ACACAUCU | 420 | AGAUGUGU CUGAUGAGGCCGUUAGGCCGAA AGGUCGAU | 1051 |
| 2024 | UAACACAU C UGAAUAC | 421 | GUAUUCA CUGAUGAGGCCGUUAGGCCGAA AUGUGUUA | 1052 |
| 2031 | UCUGAAAU A CUAGGAC | 422 | GUCCUUAG CUGAUGAGGCCGUUAGGCCGAA AUUUCAGA | 1053 |
| 2034 | GAAAUACU A AGGACCUU | 423 | AAGGUCCU CUGAUGAGGCCGUUAGGCCGAA AGUAUUUC | 1054 |
| 2042 | AAGGACCU U GACUGUGU | 424 | ACACAGUC CUGAUGAGGCCGUUAGGCCGAA AGGUCCUU | 1055 |
| 2089 | ACACAUGU U AGAGCCCU | 425 | AGGGCUCU CUGAUGAGGCCGUUAGGCCGAA ACAUGUGU | 1056 |
| 2090 | CACAUGUU A GAGCCCUU | 426 | AAGGGCUC CUGAUGAGGCCGUUAGGCCGAA AACAUGUG | 1057 |
| 2098 | AGAGCCCU U CUGAAAAA | 427 | UUUUUCAG CUGAUGAGGCCGUUAGGCCGAA AGGGCUCU | 1058 |
| 2099 | GAGCCCUU C UGAAAAAG | 428 | CUUUUUCA CUGAUGAGGCCGUUAGGCCGAA AAGGGCUC | 1059 |
| 2109 | GAAAAAGU A UCCUGCUU | 429 | AAGCAGGA CUGAUGAGGCCGUUAGGCCGAA ACUUUUUC | 1060 |
| 2111 | AAAAGUAU C CUGCUUCU | 430 | AGAAGCAG CUGAUGAGGCCGUUAGGCCGAA AUACUUUU | 1061 |
| 2117 | AUCCUGCU U CUGAUAUG | 431 | CAUAUCAG CUGAUGAGGCCGUUAGGCCGAA AGCAGGAU | 1062 |
| 2118 | UCCUGCUU C UGAUAUGC | 432 | GCAUAUCA CUGAUGAGGCCGUUAGGCCGAA AAGCAGGA | 1063 |

TABLE VIII-continued

Human PKR Hammerhead and Substrate Sequence

| Pos | Substrate | Seq ID | Hammerhead | Seq ID |
|---|---|---|---|---|
| 2123 | CUUCUGAU A UGCAGUUU | 433 | AAACUGCA CUGAUGAGGCCGUUAGGCCGAA AUCAGAAG | 1064 |
| 2130 | UAUGCAGU U UUCCUUAA | 434 | UUAAGGAA CUGAUGAGGCCGUUAGGCCGAA ACUGCAUA | 1065 |
| 2131 | AUGCAGUU U UCCUUAAA | 435 | UUUAAGGA CUGAUGAGGCCGUUAGGCCGAA AACUGCAU | 1066 |
| 2132 | UGCAGUUU U CCUUAAAU | 436 | AUUUAAGG CUGAUGAGGCCGUUAGGCCGAA AAACUGCA | 1067 |
| 2133 | GCAGUUUU C CUUAAAUU | 437 | AAUUUAAG CUGAUGAGGCCGUUAGGCCGAA AAAACUGC | 1068 |
| 2136 | GUUUUCCU U AAAUUAUC | 438 | GAUAAUUU CUGAUGAGGCCGUUAGGCCGAA AGGAAAAC | 1069 |
| 2137 | UUUUCCUU A AAUUAUCU | 439 | AGAUAAUU CUGAUGAGGCCGUUAGGCCGAA AAGGAAAA | 1070 |
| 2141 | CCUUAAAU U AUCAAAA | 440 | UUUUAGAU CUGAUGAGGCCGUUAGGCCGAA AUUUAAGG | 1071 |
| 2142 | CUUAAAUU A UCAAAAU | 441 | AUUUUAGA CUGAUGAGGCCGUUAGGCCGAA AAUUUAAG | 1072 |
| 2144 | UAAAAUAU C UAAAAUCU | 442 | AGAUUUUA CUGAUGAGGCCGUUAGGCCGAA AUAAUUUA | 1073 |
| 2146 | AAUUAUCU A AAAUCUGC | 443 | GCAGAUUU CUGAUGAGGCCGUUAGGCCGAA AGAUAAUU | 1074 |
| 2151 | UCUAAAAU C UGCUAGGG | 444 | CCCUAGCA CUGAUGAGGCCGUUAGGCCGAA AUUUUAGA | 1075 |
| 2156 | AAUCUGCU A GGGAAUAU | 445 | AUAUUCCC CUGAUGAGGCCGUUAGGCCGAA AGCAGAUU | 1076 |
| 2163 | UAGGGAAU A UCAAUAGA | 446 | UCUAUUGA CUGAUGAGGCCGUUAGGCCGAA AUUCCCUA | 1077 |
| 2165 | GGGAAUAU C AAUAGAUA | 447 | UAUCUAUU CUGAUGAGGCCGUUAGGCCGAA AUAUUCCC | 1078 |
| 2169 | AUAUCAAU A GAUAUUUA | 448 | UAAAUAUC CUGAUGAGGCCGUUAGGCCGAA AUUGAUAU | 1079 |
| 2173 | CAAUAGAU A UUUACCUU | 449 | AAGGUAAA CUGAUGAGGCCGUUAGGCCGAA AUCUAUUG | 1080 |
| 2175 | AUAGAUAU U UACCUUUU | 450 | AAAAGGUA CUGAUGAGGCCGUUAGGCCGAA AUAUCUAU | 1081 |
| 2176 | UAGAUAUU U ACCUUUUA | 451 | UAAAAGGU CUGAUGAGGCCGUUAGGCCGAA AAUAUCUA | 1082 |
| 2177 | AGAUAUUU A CCUUUUAU | 452 | AUAAAAGG CUGAUGAGGCCGUUAGGCCGAA AAAUAUCU | 1083 |
| 2181 | AUUUACCU U UUAUUUUA | 453 | UAAAAUAA CUGAUGAGGCCGUUAGGCCGAA AGGUAAAU | 1084 |
| 2182 | UUUACCUU U UAUUUUAA | 454 | UUAAAAUA CUGAUGAGGCCGUUAGGCCGAA AAGGUAAA | 1085 |
| 2183 | UUACCUUU U AUUUUAAU | 455 | AUUAAAAU CUGAUGAGGCCGUUAGGCCGAA AAACGUAA | 1086 |
| 2184 | UACCUUUU A UUUUAAUG | 456 | CAUUAAAA CUGAUGAGGCCGUUAGGCCGAA AAAAGGUA | 1087 |
| 2186 | CCUUUUAU U UUAAUGUU | 457 | AACAUUAA CUGAUGAGGCCGUUAGGCCGAA AUAAAAGG | 1088 |
| 2187 | CUUUUAUU U UAAUGUUU | 458 | AAACAUUA CUGAUGAGGCCGUUAGGCCGAA AAUAAAAG | 1089 |
| 2188 | UUUUAUUU U AAUGUUUC | 459 | GAAACAUU CUGAUGAGGCCGUUAGGCCGAA AAAUAAAA | 1090 |
| 2189 | UUUAUUUU A AUGUUUCC | 460 | GGAAACAU CUGAUGAGGCCGUUAGGCCGAA AAAAUAAA | 1091 |
| 2194 | UUUAAUGU U UCCUUUAA | 461 | UUAAAGGA CUGAUGAGGCCGUUAGGCCGAA ACAUUAAA | 1092 |
| 2195 | UUAAUGUU U CCUUUAAU | 462 | AUUAAAGG CUGAUGAGGCCGUUAGGCCGAA AACAUUAA | 1093 |
| 2196 | UAAUGUUU C CUUUAAUU | 463 | AAUUAAAG CUGAUGAGGCCGUUAGGCCGAA AAACAUUA | 1094 |
| 2199 | UGUUUCCU U UAAUUUUU | 464 | AAAAAUUA CUGAUGAGGCCGUUAGGCCGAA AGGAAACA | 1095 |
| 2200 | GUUUCCUU U AAUUUUUU | 465 | AAAAAAUU CUGAUGAGGCCGUUAGGCCGAA AAGGAAAC | 1096 |
| 2201 | UUUCCUUU A AUUUUUUA | 466 | UAAAAAAU CUGAUGAGGCCGUUAGGCCGAA AAAGGAAA | 1097 |
| 2204 | CCUUUAAU U UUUUACUA | 467 | UAGUAAAA CUGAUGAGGCCGUUAGGCCGAA AUUAAAGG | 1098 |
| 2205 | CUUUAAUU U UUUACUAU | 468 | AUAGUAAA CUGAUGAGGCCGUUAGGCCGAA AAUUAAAG | 1099 |
| 2206 | UUUAAUUU U UUACUAUU | 469 | AAUAGUAA CUGAUGAGGCCGUUAGGCCGAA AAAUUAAA | 1100 |
| 2207 | UUAAUUUU U UACUAUUU | 470 | AAAUAGUA CUGAUGAGGCCGUUAGGCCGAA AAAAUUAA | 1101 |
| 2208 | UAAUUUUU U ACUAUUUU | 471 | AAAAUAGU CUGAUGAGGCCGUUAGGCCGAA AAAAAUUA | 1102 |
| 2209 | AAUUUUUU A CUAUUUUU | 472 | AAAAAUAG CUGAUGAGGCCGUUAGGCCGAA AAAAAAUU | 1103 |
| 2212 | UUUUUACU A UUUUACU | 473 | AGUAAAAA CUGAUGAGGCCGUUAGGCCGAA AGUAAAAA | 1104 |
| 2214 | UUUACUAU U UUUACUAA | 474 | UUAGUAAA CUGAUGAGGCCGUUAGGCCGAA AUAGUAAA | 1105 |
| 2215 | UUACUAUU U UUACUAAU | 475 | AUUAGUAA CUGAUGAGGCCGUUAGGCCGAA AAUAGUAA | 1106 |
| 2216 | UACUAUUU U UACUAAUC | 476 | GAUUAGUA CUGAUGAGGCCGUUAGGCCGAA AAAUAGUA | 1107 |
| 2217 | ACUAUUUU U ACUAAUCU | 477 | AGAUUAGU CUGAUGAGGCCGUUAGGCCGAA AAAAUAGU | 1108 |
| 2218 | CUAUUUUU A CUAACUU | 478 | AAGAUUAG CUGAUGAGGCCGUUAGGCCGAA AAAAAUAG | 1109 |
| 2221 | UUUUUACU A AUCUUUCU | 479 | AGAAAGAU CUGAUGAGGCCGUUAGGCCGAA AGUAAAAA | 1110 |
| 2224 | UUACUAAU C UUUCUGCA | 480 | UGCAGAAA CUGAUGAGGCCGUUAGGCCGAA AUUAGUAA | 1111 |
| 2226 | ACUAAUCU U UCUGCAGA | 481 | UCUGCAGA CUGAUGAGGCCGUUAGGCCGAA AGAUUAGU | 1112 |
| 2227 | CUAAUCUU U CUGCAGAA | 482 | UUCUGCAG CUGAUGAGGCCGUUAGGCCGAA AAGAUUAG | 1113 |
| 2228 | UAAUCUUU C UGCAGAAA | 483 | UUUCUGCA CUGAUGAGGCCGUUAGGCCGAA AAAGAUUA | 1114 |
| 2246 | AGAAGGU U UUCUUCUU | 484 | AAGAAGAA CUGAUGAGGCCGUUAGGCCGAA ACCUUUCU | 1115 |
| 2247 | GAAAGGU U UCUUCUUU | 485 | AAAGAAGA CUGAUGAGGCCGUUAGGCCGAA AACCUUUC | 1116 |
| 2248 | AAAGGUUU U CUUCUUUU | 486 | AAAAGAAG CUGAUGAGGCCGUUAGGCCGAA AAACCUUU | 1117 |
| 2249 | AAGGUUUU C UUCUUUUU | 487 | AAAAAGAA CUGAUGAGGCCGUUAGGCCGAA AAAACCUU | 1118 |
| 2251 | GGUUUUCU U CUUUUUGC | 488 | GCAAAAAG CUGAUGAGGCCGUUAGGCCGAA AGAAACCC | 1119 |
| 2252 | GUUUUCUU C UUUUUGCU | 489 | AGCAAAAA CUGAUGAGGCCGUUAGGCCGAA AAGAAAAC | 1120 |
| 2254 | UUUCUUCU U UUUGCUUC | 490 | GAAGCAAA CUGAUGAGGCCGUUAGGCCGAA AGAAGAAA | 1121 |
| 2255 | UUCUUCUU U UUGCUUCA | 491 | UGAAGCAA CUGAUGAGGCCGUUAGGCCGAA AAGAAGAA | 1122 |
| 2256 | UCUUCUUU U UGCUUCAA | 492 | UUGAAGCA CUGAUGAGGCCGUUAGGCCGAA AAAGAAGA | 1123 |
| 2257 | CUUCUUUU U GCUUCAAA | 493 | UUUGAAGC CUGAUGAGGCCGUUAGGCCGAA AAAAGAAG | 1124 |
| 2261 | UUUUGCU U CAAAACA | 494 | UGUUUUUG CUGAUGAGGCCGUUAGGCCGAA AGCAAAAA | 1125 |
| 2262 | UUUUGCUU C AAAACAU | 495 | AUGUUUUU CUGAUGAGGCCGUUAGGCCGAA AAGCAAAA | 1126 |
| 2271 | AAAAACAU U CUUACAUU | 496 | AAUGUAAG CUGAUGAGGCCGUUAGGCCGAA AUGUUUUU | 1127 |
| 2272 | AAAACAUU C UUACAUUU | 497 | AAAUGUAA CUGAUGAGGCCGUUAGGCCGAA AAUGUUUU | 1128 |
| 2274 | AACAUUCU U ACAUUUUA | 498 | UAAAAUGU CUGAUGAGGCCGUUAGGCCGAA AGAAUGUU | 1129 |
| 2275 | ACAUUCUU A CAUUUUAC | 499 | GUAAAAUG CUGAUGAGGCCGUUAGGCCGAA AGAAUGU | 1130 |
| 2279 | UCUUACAU U UACUUUUU | 500 | AAAAGUAA CUGAUGAGGCCGUUAGGCCGAA AUGUAAGA | 1131 |
| 2280 | CUUACAUU U UACUUUUU | 501 | AAAAAGUA CUGAUGAGGCCGUUAGGCCGAA AAUGUAAG | 1132 |
| 2281 | UUACAUUU U ACUUUUCC | 502 | GAAAAGU CUGAUGAGGCCGUUAGGCCGAA AAAUGUAA | 1133 |
| 2282 | UACAUUUU A CUUUUCCU | 503 | GGAAAAG CUGAUGAGGCCGUUAGGCCGAA AAAAUGUA | 1134 |
| 2285 | AUUUUACU U UUCCUGG | 504 | CCAGGAA CUGAUGAGGCCGUUAGGCCGAA AGUAAAAU | 1135 |
| 2286 | UUUUACUU U UCCUGGC | 505 | GCCAGGAA CUGAUGAGGCCGUUAGGCCGAA AAGUAAAA | 1136 |
| 2287 | UUUACUUU U CCUGGCU | 506 | AGCCAGGA CUGAUGAGGCCGUUAGGCCGAA AAAGUAAA | 1137 |
| 2288 | UUACUUUU U CCUGGCUC | 507 | GAGCCAGG CUGAUGAGGCCGUUAGGCCGAA AAAAGUAA | 1138 |

TABLE VIII-continued

Human PKR Hammerhead and Substrate Sequence

| Pos | Substrate | Seq ID | Hammerhead | Seq ID |
|---|---|---|---|---|
| 2289 | UACUUUUU C CUGGCUCA | 508 | UGAGCCAG CUGAUGAGGCCGUUAGGCCGAA AAAAAGUA | 1139 |
| 2296 | UCCUGGCU C AUCUCUUU | 509 | AAAGAGAU CUGAUGAGGCCGUUAGGCCGAA AGCCAGGA | 1140 |
| 2299 | UGGCUCAU C UCUUUAUU | 510 | AAUAAAGA CUGAUGAGGCCGUUAGGCCGAA AUGAGCCA | 1141 |
| 2301 | GCUCAUCU C UUUAUUCU | 511 | AGAAUAAA CUGAUGAGGCCGUUAGGCCGAA AGAUGAGC | 1142 |
| 2303 | UCAUCUCU U UAUUCUUU | 512 | AAAGAAUA CUGAUGAGGCCGUUAGGCCGAA AGAGAUGA | 1143 |
| 2304 | CAUCUCUU U AUUCUUUU | 513 | AAAAGAAU CUGAUGAGGCCGUUAGGCCGAA AAGAGAUG | 1144 |
| 2305 | AUCUCUUU A UUCUUUUU | 514 | AAAAAGAA CUGAUGAGGCCGUUAGGCCGAA AAAGAGAU | 1145 |
| 2307 | CUCUUUAU U CUUUUUUU | 515 | AAAAAAAG CUGAUGAGGCCGUUAGGCCGAA AUAAAGAG | 1146 |
| 2308 | UCUUUAUU C UUUUUUUU | 516 | AAAAAAAA CUGAUGAGGCCGUUAGGCCGAA AAUAAAGA | 1147 |
| 2310 | UUUAUCUU U UUUUUUUU | 517 | AAAAAAAA CUGAUGAGGCCGUUAGGCCGAA AGAAUAAA | 1148 |
| 2311 | UUAUCUUU U UUUUUUUU | 518 | AAAAAAAA CUGAUGAGGCCGUUAGGCCGAA AAGAAUAA | 1149 |
| 2312 | UAUUCUUU U UUUUUUUU | 519 | AAAAAAAA CUGAUGAGGCCGUUAGGCCGAA AAAGAAUA | 1150 |
| 2313 | AUUCUUUU U UUUUUUUU | 520 | AAAAAAAA CUGAUGAGGCCGUUAGGCCGAA AAAAGAAU | 1151 |
| 2314 | UUCUUUUU U UUUUUUUU | 521 | AAAAAAAA CUGAUGAGGCCGUUAGGCCGAA AAAAAGAA | 1152 |
| 2315 | UCUUUUUU U UUUUUUUA | 522 | UAAAAAAA CUGAUGAGGCCGUUAGGCCGAA AAAAAAGA | 1153 |
| 2316 | CUUUUUUU U UUUUUUAA | 523 | UUAAAAAA CUGAUGAGGCCGUUAGGCCGAA AAAAAAAG | 1154 |
| 2317 | UUUUUUUU U UUUUUAAA | 524 | UUUAAAAA CUGAUGAGGCCGUUAGGCCGAA AAAAAAAA | 1155 |
| 2318 | UUUUUUUU U UUUUAAAG | 525 | CUUUAAAA CUGAUGAGGCCGUUAGGCCGAA AAAAAAAA | 1156 |
| 2319 | UUUUUUUU U UUUAAAGA | 526 | UCUUUAAA CUGAUGAGGCCGUUAGGCCGAA AAAAAAAA | 1157 |
| 2320 | UUUUUUUU U UUAAAGAC | 527 | GUCUUUAA CUGAUGAGGCCGUUAGGCCGAA AAAAAAAA | 1158 |
| 2321 | UUUUUUUU U UAAAGACA | 528 | UGUCUUUA CUGAUGAGGCCGUUAGGCCGAA AAAAAAAA | 1159 |
| 2322 | UUUUUUUU U AAAGACAG | 529 | CUGUCUUU CUGAUGAGGCCGUUAGGCCGAA AAAAAAAA | 1160 |
| 2323 | UUUUUUUU A AAGACAGA | 530 | UCUGUCUU CUGAUGAGGCCGUUAGGCCGAA AAAAAAAA | 1161 |
| 2334 | GACAGAGU C UCGCUCUG | 531 | CAGAGCGA CUGAUGAGGCCGUUAGGCCGAA ACUCUGUC | 1162 |
| 2336 | CAGAGUCU C GCUCUGUU | 532 | AACAGAGC CUGAUGAGGCCGUUAGGCCGAA AGACUCUG | 1163 |
| 2340 | GUCUCGCU C UGUUGCCC | 533 | GGGCAACA CUGAUGAGGCCGUUAGGCCGAA AGCGAGAC | 1164 |
| 2344 | CGCUCUGU U GCCCAGGC | 534 | GCCUGGGC CUGAUGAGGCCGUUAGGCCGAA ACAGAGCG | 1165 |
| 2372 | GACACAGU C UUGGCUCA | 535 | UGAGCCAA CUGAUGAGGCCGUUAGGCCGAA ACUGUGUC | 1166 |
| 2374 | CACAGUCU U GGCUCACU | 536 | AGUGAGCC CUGAUGAGGCCGUUAGGCCGAA AGACUGUG | 1167 |
| 2379 | UCUUGGCU C ACUGCAAC | 537 | GUUGCAGU CUGAUGAGGCCGUUAGGCCGAA AGCCAAGA | 1168 |
| 2389 | CUGCAACU U CUGCCUCU | 538 | AGAGGCAG CUGAUGAGGCCGUUAGGCCGAA AGUUGCAG | 1169 |
| 2390 | UGCAACUU C UGCCUCUU | 539 | AAGAGGCA CUGAUGAGGCCGUUAGGCCGAA AAGUUGCA | 1170 |
| 2396 | UUCUGCCU C UUGGGUUC | 540 | GAACCCAA CUGAUGAGGCCGUUAGGCCGAA AGGCAGAA | 1171 |
| 2398 | CUGCCUCU U GGGUUCAA | 541 | UUGAACCC CUGAUGAGGCCGUUAGGCCGAA AGAGGCAG | 1172 |
| 2403 | UCUUGGGU U CAAGUGAU | 542 | AUCACUUG CUGAUGAGGCCGUUAGGCCGAA ACCCAAGA | 1173 |
| 2404 | CUUGGGUU C AAGUGAUU | 543 | AAUCACUU CUGAUGAGGCCGUUAGGCCGAA AACCCAAG | 1174 |
| 2412 | CAAGUGAU U CUCCUGCC | 544 | GGCAGGAG CUGAUGAGGCCGUUAGGCCGAA AUCACUUG | 1175 |
| 2413 | AAGUGAUU C UCCUGCCU | 545 | AGGCAGGA CUGAUGAGGCCGUUAGGCCGAA AAUCACUU | 1176 |
| 2415 | GUGAUUCU C CUGCCUCA | 546 | UGAGGCAG CUGAUGAGGCCGUUAGGCCGAA AGAAUCAC | 1177 |
| 2422 | UCCUGCCU C AGCCUCCU | 547 | AGGAGGCU CUGAUGAGGCCGUUAGGCCGAA AGGCAGGA | 1178 |
| 2428 | CUCAGCCU C CUGAGUAG | 548 | CUACUCAG CUGAUGAGGCCGUUAGGCCGAA AGGCUGAG | 1179 |
| 2435 | UCCUGAGU A GCUGGAUU | 549 | AAUCCAGC CUGAUGAGGCCGUUAGGCCGAA ACUCAGGA | 1180 |
| 2443 | AGCUGGAU U ACAGGCAU | 550 | AUGCCUGU CUGAUGAGGCCGUUAGGCCGAA AUCCAGCU | 1181 |
| 2444 | GCUGGAUU A CAGGCAUG | 551 | CAUGCCUG CUGAUGAGGCCGUUAGGCCGAA AAUCCAGC | 1182 |
| 2469 | ACCCAACU A AUUUUUGU | 552 | ACAAAAAU CUGAUGAGGCCGUUAGGCCGAA AGUUGGGU | 1183 |
| 2472 | CAACUAAU U UUUGUGUU | 553 | AACACAAA CUGAUGAGGCCGUUAGGCCGAA AUUAGUUG | 1184 |
| 2473 | AACUAAUU U UUGUGUUU | 554 | AAACACAA CUGAUGAGGCCGUUAGGCCGAA AAUUAGUU | 1185 |
| 2474 | ACUAAUUU U UGUGUUUU | 555 | AAAACACA CUGAUGAGGCCGUUAGGCCGAA AAAUUAGU | 1186 |
| 2475 | CUAAUUUU U GUGUUUUU | 556 | AAAAACAC CUGAUGAGGCCGUUAGGCCGAA AAAAUUAG | 1187 |
| 2480 | UUUUGUGU U UUUAAUAA | 557 | UUAAUUAA CUGAUGAGGCCGUUAGGCCGAA ACACAAAA | 1188 |
| 2481 | UUUGUGUU U UUAAUAAA | 558 | UUUAUUAA CUGAUGAGGCCGUUAGGCCGAA AACACAAA | 1189 |
| 2482 | UUGUGUUU U UAAUAAAG | 559 | CUUUAUUA CUGAUGAGGCCGUUAGGCCGAA AAACACAA | 1190 |
| 2483 | UGUGUUUU U AAUAAAGA | 560 | UCUUUAUU CUGAUGAGGCCGUUAGGCCGAA AAAACACA | 1191 |
| 2484 | GUGUUUUU A AUAAAGAC | 561 | GUCUUUAU CUGAUGAGGCCGUUAGGCCGAA AAAAACAC | 1192 |
| 2487 | UUUUUAAU A AGACAGG | 562 | CCUGUCUU CUGAUGAGGCCGUUAGGCCGAA AUUAAAAA | 1193 |
| 2498 | GACAGGGU U UCACCAUG | 563 | CAUGGUGA CUGAUGAGGCCGUUAGGCCGAA ACCCUGUC | 1194 |
| 2499 | ACAGGGUU U CACCAUGU | 564 | ACAUGGUG CUGAUGAGGCCGUUAGGCCGAA AACCCUGU | 1195 |
| 2500 | CAGGGUUU C ACCAUGUU | 565 | AACAUGGU CUGAUGAGGCCGUUAGGCCGAA AAACCCUG | 1196 |
| 2508 | CACCAUGU U GGCCAGGC | 566 | GCCUGGCC CUGAUGAGGCCGUUAGGCCGAA ACAUGGUG | 1197 |
| 2521 | AGGCUGGU C UCAAACUC | 567 | GAGUUUGA CUGAUGAGGCCGUUAGGCCGAA ACCAGCCU | 1198 |
| 2523 | GCUGGUCU C AAACUCCU | 568 | AGGAGUUU CUGAUGAGGCCGUUAGGCCGAA AGACCAGC | 1199 |
| 2529 | CUCAAACU C CUGACCUC | 569 | GAGGUCAG CUGAUGAGGCCGUUAGGCCGAA AGUUUGAG | 1200 |
| 2537 | CCUGACCU C AAGUAAUC | 570 | GAUUACUU CUGAUGAGGCCGUUAGGCCGAA AGGUCAGG | 1201 |
| 2542 | CCUCAAGU A AUCCACCU | 571 | AGGUGGAU CUGAUGAGGCCGUUAGGCCGAA ACUUGAGG | 1202 |
| 2545 | CAAGUAAU C CACCUGCC | 572 | GGCAGGUG CUGAUGAGGCCGUUAGGCCGAA AUUACUUG | 1203 |
| 2555 | ACCUGCCU C GGCCUCCC | 573 | GGGAGGCC CUGAUGAGGCCGUUAGGCCGAA AGGCAGGU | 1204 |
| 2561 | CUCGGCCU C CCAAAGUG | 574 | CACUUUGG CUGAUGAGGCCGUUAGGCCGAA AGGCCGAG | 1205 |
| 2577 | GCUGGGAU U ACAGGGAU | 575 | AUCCCUGU CUGAUGAGGCCGUUAGGCCGAA AUCCCAGC | 1206 |
| 2578 | CUGGGAUU A CAGGGAUG | 576 | CAUCCCUG CUGAUGAGGCCGUUAGGCCGAA AAUCCCAG | 1207 |
| 2605 | CCCAGCCU C AUCUCUUU | 577 | AAAGAGAU CUGAUGAGGCCGUUAGGCCGAA AGGCUGGG | 1208 |
| 2608 | AGCCUCAU C UCUUUGUU | 578 | AACAAAGA CUGAUGAGGCCGUUAGGCCGAA AUGAGGCU | 1209 |
| 2610 | CCUCAUCU C UUUGUUCU | 579 | AGAACAAA CUGAUGAGGCCGUUAGGCCGAA AGAUGAGG | 1210 |
| 2612 | UCAUCUCU U UGUUCUAA | 580 | UUAGAACA CUGAUGAGGCCGUUAGGCCGAA AGAGAUGA | 1211 |
| 2613 | CAUCUCUU U GUUCUAAA | 581 | UUUAGAAC CUGAUGAGGCCGUUAGGCCGAA AAGAGAUG | 1212 |
| 2616 | CUCUUUGU U CUAAAGAU | 582 | AUCUUUAG CUGAUGAGGCCGUUAGGCCGAA ACAAAGAG | 1213 |

TABLE VIII-continued

Human PKR Hammerhead and Substrate Sequence

| Pos | Substrate | Seq ID | Hammerhead | Seq ID |
|---|---|---|---|---|
| 2617 | UCUUUGUU C UAAAGAUG | 583 | CAUCUUUA CUGAUGAG<u>GCCGUUAGGC</u>CGAA AACAAAGA | 1214 |
| 2619 | UUUGUUCU A AAGAUGGA | 584 | UCCAUCUU CUGAUGAG<u>GCCGUUAGGC</u>CGAA AGAACAAA | 1215 |
| 2644 | CCCCAAAU U UUCUUUUU | 585 | AAAAAGAA CUGAUGAG<u>GCCGUUAGGC</u>CGAA AUUUGGGG | 1216 |
| 2645 | CCCAAAUU U UCUUUUUA | 586 | UAAAAAGA CUGAUGAG<u>GCCGUUAGGC</u>CGAA AAUUUGGG | 1217 |
| 2646 | CCAAAUUU U CUUUUUAU | 587 | AUAAAAAG CUGAUGAG<u>GCCGUUAGGC</u>CGAA AAAUUUGG | 1218 |
| 2647 | CAAAUUUU C UUUUUAUA | 588 | UAUAAAAA CUGAUGAG<u>GCCGUUAGGC</u>CGAA AAAAUUUG | 1219 |
| 2649 | AAUUUUCU U UUUAUACU | 589 | AGUAUAAA CUGAUGAG<u>GCCGUUAGGC</u>CGAA AGAAAAUU | 1220 |
| 2650 | AUUUUCUU U UUAUACUA | 590 | UAGUAUAA CUGAUGAG<u>GCCGUUAGGC</u>CGAA AAGAAAAU | 1221 |
| 2651 | UUUUCUUU U UAUACUAU | 591 | AUAGUAUA CUGAUGAG<u>GCCGUUAGGC</u>CGAA AAAGAAAA | 1222 |
| 2652 | UUUCUUUU U AUACUAUU | 592 | AAUAGUAU CUGAUGAG<u>GCCGUUAGGC</u>CGAA AAAAGAAA | 1223 |
| 2653 | UUCUUUUU A UACUAUUA | 593 | UAAUAGUA CUGAUGAG<u>GCCGUUAGGC</u>CGAA AAAAAGAA | 1224 |
| 2655 | CUUUUUAU A CUAUUAAU | 594 | AUUAAUAG CUGAUGAG<u>GCCGUUAGGC</u>CGAA AUAAAAAG | 1225 |
| 2658 | UUUAUACU A UUAAUGAA | 595 | UUCAUUAA CUGAUGAG<u>GCCGUUAGGC</u>CGAA AGUAUAAA | 1226 |
| 2660 | UAUACUAU U AAUGAAUC | 596 | GAUUCAUU CUGAUGAG<u>GCCGUUAGGC</u>CGAA AUAGUAUA | 1227 |
| 2661 | AUACUAUU A AUGAAUCA | 597 | UGAUUCAU CUGAUGAG<u>GCCGUUAGGC</u>CGAA AAUAGUAU | 1228 |
| 2668 | UAAUGAAU C AAUCAAUU | 598 | AAUUGAUU CUGAUGAG<u>GCCGUUAGGC</u>CGAA AUUCAUUA | 1229 |
| 2672 | GAAUCAAU C AAUUCAUA | 599 | UAUGAAUU CUGAUGAG<u>GCCGUUAGGC</u>CGAA AUUGAUUC | 1230 |
| 2676 | CAAUCAAU U CAUUCUA | 600 | UAGAUAUG CUGAUGAG<u>GCCGUUAGGC</u>CGAA AUUGAUUG | 1231 |
| 2677 | AAUCAAUU C AUAUCUAU | 601 | AUAGAUAU CUGAUGAG<u>GCCGUUAGGC</u>CGAA AAUUGAUU | 1232 |
| 2680 | CAAUUCAU A UCUAUUUA | 602 | UAAAUAGA CUGAUGAG<u>GCCGUUAGGC</u>CGAA AUGAAUUG | 1233 |
| 2682 | AUUCAUAU C UAUUUAUU | 603 | AAUAAAUA CUGAUGAG<u>GCCGUUAGGC</u>CGAA AUAUGAAU | 1234 |
| 2684 | UCAUAUCU A UUUAUUAA | 604 | UUAAUAAA CUGAUGAG<u>GCCGUUAGGC</u>CGAA AGAUAUGA | 1235 |
| 2686 | AUAUCUAU U UAUUAAAU | 605 | AUUUAAUA CUGAUGAG<u>GCCGUUAGGC</u>CGAA AUAGAUAU | 1236 |
| 2687 | UAUCUAUU U AUUAAAUU | 606 | AAUUUAAU CUGAUGAG<u>GCCGUUAGGC</u>CGAA AAUAGAUA | 1237 |
| 2688 | AUCUAUUU A UUAAAUUU | 607 | AAAUUUAA CUGAUGAG<u>GCCGUUAGGC</u>CGAA AAAUAGAU | 1238 |
| 2690 | CUAUUUAU U AAAUUUCU | 608 | AGAAAUUU CUGAUGAG<u>GCCGUUAGGC</u>CGAA AUAAAUAG | 1239 |
| 2691 | UAUUUAUU A AAUUUCUA | 609 | UAGAAAUU CUGAUGAG<u>GCCGUUAGGC</u>CGAA AAUAAAUA | 1240 |
| 2695 | UAUUAAAU U UCUACCGC | 610 | GCGGUAGA CUGAUGAG<u>GCCGUUAGGC</u>CGAA AUUUAAUA | 1241 |
| 2696 | AUUAAAUU U CUACCGCU | 611 | AGCGGUAG CUGAUGAG<u>GCCGUUAGGC</u>CGAA AAUUUAAU | 1242 |
| 2697 | UUAAAUUU C UACCGCUU | 612 | AAGCGGUA CUGAUGAG<u>GCCGUUAGGC</u>CGAA AAAUUUAA | 1243 |
| 2699 | AAAUUUCU A CCGCUUUU | 613 | AAAAGCGG CUGAUGAG<u>GCCGUUAGGC</u>CGAA AGAAAUUU | 1244 |
| 2705 | CUACCGCU U UUAGGCCA | 614 | UGGCCUAA CUGAUGAG<u>GCCGUUAGGC</u>CGAA AGCGGUAG | 1245 |
| 2706 | UACCGCUU U UAGGCCAA | 615 | UUGGCCUA CUGAUGAG<u>GCCGUUAGGC</u>CGAA AAGCGGUA | 1246 |
| 2707 | ACCGCUUU U AGGCCAAA | 616 | UUUGGCCU CUGAUGAG<u>GCCGUUAGGC</u>CGAA AAAGCGGU | 1247 |
| 2708 | CCGCUUUU A GGCCAAAA | 617 | UUUUGGCC CUGAUGAG<u>GCCGUUAGGC</u>CGAA AAAAGCGG | 1248 |
| 2723 | AAAAAUGU A AGAUCGUU | 618 | AACGAUCU CUGAUGAG<u>GCCGUUAGGC</u>CGAA ACAUUUUU | 1249 |
| 2728 | UGUAAGAU C GUUCUCUG | 619 | CAGAGAAC CUGAUGAG<u>GCCGUUAGGC</u>CGAA AUCUUACA | 1250 |
| 2731 | AAGAUCGU U CUCUGCCU | 620 | AGGCAGAG CUGAUGAG<u>GCCGUUAGGC</u>CGAA ACGAUCUU | 1251 |
| 2732 | AGAUCGUU C UCUGCCUC | 621 | GAGGCAGA CUGAUGAG<u>GCCGUUAGGC</u>CGAA AACGAUCU | 1252 |
| 2734 | AUCGUUCU C UGCCUCAC | 622 | GUGAGGCA CUGAUGAG<u>GCCGUUAGGC</u>CGAA AGAACGAU | 1253 |
| 2740 | CUCUGCCU C ACAUAGCU | 623 | AGCUAUGU CUGAUGAG<u>GCCGUUAGGC</u>CGAA AGGCAGAG | 1254 |
| 2745 | CCUCACAU A GCUUACAA | 624 | UUGUAAGC CUGAUGAG<u>GCCGUUAGGC</u>CGAA AUGUGAGG | 1255 |
| 2749 | ACAUAGCU U ACAAGCCA | 625 | UGGCUUGU CUGAUGAG<u>GCCGUUAGGC</u>CGAA AGCUAUGU | 1256 |
| 2750 | CAUAGCUU A CAAGCCAG | 626 | CUGGCUUG CUGAUGAG<u>GCCGUUAGGC</u>CGAA AAGCUAUG | 1257 |
| 2769 | GGAGAAAU A UGGUACUC | 627 | GAGUACCA CUGAUGAG<u>GCCGUUAGGC</u>CGAA AUUUCUCC | 1258 |
| 2774 | AAUAUGGU A CUCAUUAA | 628 | UUAAUGAG CUGAUGAG<u>GCCGUUAGGC</u>CGAA ACCAUAUU | 1259 |
| 2777 | AUGGUACU C AUUAAAAA | 629 | UUUUUAAU CUGAUGAG<u>GCCGUUAGGC</u>CGAA AGUACCAU | 1260 |
| 2780 | GUACUCAU U AAAAAAAA | 630 | UUUUUUUU CUGAUGAG<u>GCCGUUAGGC</u>CGAA AUGAGUAC | 1261 |
| 2781 | UACUCAUU A AAAAAAA | 631 | UUUUUUUU CUGAUGAG<u>GCCGUUAGGC</u>CGAA AAUGAGUA | 1262 |

Input Sequence = NM_002759. Cut Site = UH/.
Arm Length = 8. Core Sequence = CUGAUGAG <u>GCCGUUAGGC</u> CGAA NM_002759 (*Homo sapiens* protein kinase, interferon-inducible double stranded RNA dependent (PRKR), mRNA.; 2808 bp)

50

Underlined region can be any X sequence or linker, as described herein.

TABLE IX

Human PKR Inozyme and Substrate Sequence

| Pos | Substrate | Seq ID | Inozyme | Seq ID |
|---|---|---|---|---|
| 17 | GGCGGCGC A GUUUGCUC | 1263 | GAGCAAAC CUGAUGAG<u>GCCGUUAGGC</u>CGAA ICGCCGCC | 1762 |
| 24 | CAGUUUGC U CAUACUUU | 1264 | AAAGUAUG CUGAUGAG<u>GCCGUUAGGC</u>CGAA ICAAACUG | 1763 |
| 26 | GUUUGCUC A UACUUUGU | 1265 | ACAAAGUA CUGAUGAG<u>GCCGUUAGGC</u>CGAA IAGCAAAC | 1764 |
| 30 | GCUCAUAC U UUGUGACU | 1266 | AGUCACAA CUGAUGAG<u>GCCGUUAGGC</u>CGAA IUAUGAGC | 1765 |
| 38 | UUUGUGAC U UGCGGUCA | 1267 | UGACCGCA CUGAUGAG<u>GCCGUUAGGC</u>CGAA IUCACAAA | 1766 |
| 46 | UUGCGGUC A CAGUGGCA | 1268 | UGCCACUG CUGAUGAG<u>GCCGUUAGGC</u>CGAA IACCGCAA | 1767 |
| 48 | GCGGUCAC A GUGGCAUU | 1269 | AAUGCCAC CUGAUGAG<u>GCCGUUAGGC</u>CGAA IUGACCGC | 1768 |
| 54 | ACAGUGGC A UUCAGCUC | 1270 | GAGCUGAA CUGAUGAG<u>GCCGUUAGGC</u>CGAA ICCACUGU | 1769 |

TABLE IX-continued

Human PKR Inozyme and Substrate Sequence

| Pos | Substrate | Seq ID | Inozyme | Seq ID |
|---|---|---|---|---|
| 58 | UGGCAUUC A GCUCCACA | 1271 | UGUGGAGC CUGAUGAGGCCGUUAGGCCGAA IAAUGCCA | 1770 |
| 61 | CAUUCAGC U CCACACUU | 1272 | AAGUGUGG CUGAUGAGGCCGUUAGGCCGAA ICUGAAUG | 1771 |
| 63 | UUCAGCUC C ACACUUGG | 1273 | CCAAGUGU CUGAUGAGGCCGUUAGGCCGAA IAGCUGAA | 1772 |
| 64 | UCAGCUCC A CACUUGGU | 1274 | ACCAAGUG CUGAUGAGGCCGUUAGGCCGAA IGAGCUGA | 1773 |
| 66 | AGCUCCAC A CUUGGUAG | 1275 | CUACCAAG CUGAUGAGGCCGUUAGGCCGAA IUGGAGCU | 1774 |
| 68 | CUCCACAC U UGGUAGAA | 1276 | UUCUACCA CUGAUGAGGCCGUUAGGCCGAA IUGUGGAG | 1775 |
| 78 | GGUAGAAC C ACAGGCAC | 1277 | GUGCCUGU CUGAUGAGGCCGUUAGGCCGAA IUUCUACC | 1776 |
| 79 | GUAGAACC A CAGGCACG | 1278 | CGUGCCUG CUGAUGAGGCCGUUAGGCCGAA IGUUCUAC | 1777 |
| 81 | AGAACCAC A GGCACGAC | 1279 | GUCGUGCC CUGAUGAGGCCGUUAGGCCGAA IUGGUUCU | 1778 |
| 85 | CCACAGGC A CGACAAGC | 1280 | GCUUGUCG CUGAUGAGGCCGUUAGGCCGAA ICCUGUGG | 1779 |
| 90 | GGCACGAC A AGCAUAGA | 1281 | UCUAUGCU CUGAUGAGGCCGUUAGGCCGAA IUCGUGCC | 1780 |
| 94 | CGACAAGC A UAGAAACA | 1282 | UGUUUCUA CUGAUGAGGCCGUUAGGCCGAA ICUUGUCG | 1781 |
| 102 | AUAGAAAC A UCCUAAAC | 1283 | GUUUAGGA CUGAUGAGGCCGUUAGGCCGAA IUUUCUAU | 1782 |
| 105 | GAAACAUC C UAAACAAU | 1284 | AUUGUUUA CUGAUGAGGCCGUUAGGCCGAA IAUGUUUC | 1783 |
| 106 | AAACAUCC U AAACAAUC | 1285 | GAUUGUUU CUGAUGAGGCCGUUAGGCCGAA IGAUGUUU | 1784 |
| 111 | UCCUAAAC A AUCUUCAU | 1286 | AUGAAGAU CUGAUGAGGCCGUUAGGCCGAA IUUUAGGA | 1785 |
| 115 | AAACAUC U UCAUCGAG | 1287 | CUCGAUGA CUGAUGAGGCCGUUAGGCCGAA IAUUGUUU | 1786 |
| 118 | CAAUCUUC A UCGAGGCA | 1288 | UGCCUCGA CUGAUGAGGCCGUUAGGCCGAA IAAGAUUG | 1787 |
| 126 | AUCGAGGC A UCGAGGUC | 1289 | GACCUCGA CUGAUGAGGCCGUUAGGCCGAA ICCUCGAU | 1788 |
| 135 | UCGAGGUC C AUCCCAAU | 1290 | AUUGGGAU CUGAUGAGGCCGUUAGGCCGAA IACCUCGA | 1789 |
| 136 | CGAGGUCC A UCCCAUA | 1291 | UAUUGGGA CUGAUGAGGCCGUUAGGCCGAA IGACCUCG | 1790 |
| 139 | GGUCCAUC C CAAUAAAA | 1292 | UUUUAUUG CUGAUGAGGCCGUUAGGCCGAA IAUGGACC | 1791 |
| 140 | GUCCAUCC C AAUAAAAA | 1293 | UUUUUAUU CUGAUGAGGCCGUUAGGCCGAA IGAUGGAC | 1792 |
| 141 | UCCAUCCC A AUAAAAAU | 1294 | AUUUUUAU CUGAUGAGGCCGUUAGGCCGAA IGGAUGGA | 1793 |
| 151 | UAAAAAUC G GGAGACCC | 1295 | GGGUCUCC CUGAUGAGGCCGUUAGGCCGAA IAUUUUUA | 1794 |
| 158 | CAGGAGAC C CUGGCUAU | 1296 | AUAGCCAG CUGAUGAGGCCGUUAGGCCGAA IUCUCCUG | 1795 |
| 159 | AGGAGACC C UGGCUAUC | 1297 | GAUAGCCA CUGAUGAGGCCGUUAGGCCGAA IGUCUCCU | 1796 |
| 160 | GGAGACCC U GGCUAUCA | 1298 | UGAUAGCC CUGAUGAGGCCGUUAGGCCGAA IGGUCUCC | 1797 |
| 164 | ACCCUGGC U AUCAUAGA | 1299 | UCUAUGAU CUGAUGAGGCCGUUAGGCCGAA ICCAGGGU | 1798 |
| 168 | UGGCUAUC A UAGACCUU | 1300 | AAGGUCUA CUGAUGAGGCCGUUAGGCCGAA IAUAGCCA | 1799 |
| 174 | UCAUAGAC C UUAGUCUU | 1301 | AAGACUAA CUGAUGAGGCCGUUAGGCCGAA IUCUAUGA | 1800 |
| 175 | CAUAGACC U UAGUCUUC | 1302 | GAAGACUA CUGAUGAGGCCGUUAGGCCGAA IGUCUAUG | 1801 |
| 181 | CCUUAGUC U UCGCUGGU | 1303 | ACCAGCGA CUGAUGAGGCCGUUAGGCCGAA IACUAAGG | 1802 |
| 186 | GUCUUCGC U GGUAUACU | 1304 | AGUAUACC CUGAUGAGGCCGUUAGGCCGAA ICGAAGAC | 1803 |
| 194 | UGGUAUAC U CGCUGUCU | 1305 | AGACAGCG CUGAUGAGGCCGUUAGGCCGAA IUAUACCA | 1804 |
| 198 | AUACUCGC U GUCUGUCA | 1306 | UGACAGAC CUGAUGAGGCCGUUAGGCCGAA ICGAGUAU | 1805 |
| 202 | UCGCUGUC U GUCAACCA | 1307 | UGGUUGAC CUGAUGAGGCCGUUAGGCCGAA IACAGCGA | 1806 |
| 206 | UGUCUGUC A ACCAGCGG | 1308 | CCGCUGGU CUGAUGAGGCCGUUAGGCCGAA IACAGACA | 1807 |
| 209 | CUGUCAAC C AGCGGUUG | 1309 | CAACCGCU CUGAUGAGGCCGUUAGGCCGAA IUUGACAG | 1808 |
| 210 | UGUCAACC A GCGGUUGA | 1310 | UCAACCGC CUGAUGAGGCCGUUAGGCCGAA IGUUGACA | 1809 |
| 220 | CGGUUGAC U UUUUUUAA | 1311 | UUAAAAAA CUGAUGAGGCCGUUAGGCCGAA IUCAACCG | 1810 |
| 231 | UUUUAAGC U UUCUUUUU | 1312 | AAAAAGAA CUGAUGAGGCCGUUAGGCCGAA ICUUAAAA | 1811 |
| 232 | UUUAAGCC U UCUUUUUC | 1313 | AAAAAAGA CUGAUGAGGCCGUUAGGCCGAA IGCUUAAA | 1812 |
| 235 | AAGCCUUC U UUUUCUC | 1314 | GAGAAAAA CUGAUGAGGCCGUUAGGCCGAA IAAGGCUU | 1813 |
| 242 | CUUUUUUC U CUUUUACC | 1315 | GGUAAAAG CUGAUGAGGCCGUUAGGCCGAA IAAAAAAG | 1814 |
| 244 | UUUUUCUC U UUUACCAG | 1316 | CUGGUAAA CUGAUGAGGCCGUUAGGCCGAA IAGAAAAA | 1815 |
| 250 | UCUUUUAC C AGUUUCUG | 1317 | CAGAAACU CUGAUGAGGCCGUUAGGCCGAA IUAAAAGA | 1816 |
| 251 | CUUUUACC A GUUUCUGG | 1318 | CCAGAAAC CUGAUGAGGCCGUUAGGCCGAA IGUAAAAG | 1817 |
| 257 | CCAGUUUC U GGAGCAAA | 1319 | UUUGCUCC CUGAUGAGGCCGUUAGGCCGAA IAAACUGG | 1818 |
| 263 | UCUGGAGC A AAUUCAGU | 1320 | ACUGAAUU CUGAUGAGGCCGUUAGGCCGAA ICUCCAGA | 1819 |
| 269 | GCAAAUUC A GUUGCCU | 1321 | AGGCAAAC CUGAUGAGGCCGUUAGGCCGAA IAAUUUGC | 1820 |
| 276 | CAGUUUGC C UUCCUGGA | 1322 | UCCAGGAA CUGAUGAGGCCGUUAGGCCGAA ICAAACUG | 1821 |
| 277 | AGUUUGCC U UCCUGGAU | 1323 | AUCCAGGA CUGAUGAGGCCGUUAGGCCGAA IGCAAACU | 1822 |
| 280 | UUGCCUUC C UGGAUUUG | 1324 | CAAAUCCA CUGAUGAGGCCGUUAGGCCGAA IAAGGCAA | 1823 |
| 281 | UGCCUUCC U GGAUUUGU | 1325 | ACAAAUCC CUGAUGAGGCCGUUAGGCCGAA IGAAGGCA | 1824 |
| 303 | GUAAUGAC C UCAAAACU | 1326 | AGUUUUGA CUGAUGAGGCCGUUAGGCCGAA IUCAUUAC | 1825 |
| 304 | UAAUGACC U CAAAACUU | 1327 | AAGUUUUG CUGAUGAGGCCGUUAGGCCGAA IGUCAUUA | 1826 |
| 306 | AUGACCUC A AAACUUUA | 1328 | UAAAGUUU CUGAUGAGGCCGUUAGGCCGAA IAGGUCAU | 1827 |
| 311 | CUCAAAAC U UUAGCAGU | 1329 | ACUGCUAA CUGAUGAGGCCGUUAGGCCGAA IUUUUGAG | 1828 |
| 317 | ACUUUAGC A GUUCUUCC | 1330 | GGAAGAAC CUGAUGAGGCCGUUAGGCCGAA ICUAAAGU | 1829 |
| 322 | AGCAGUUC U UCCAUCUG | 1331 | CAGAUGGA CUGAUGAGGCCGUUAGGCCGAA IAACUGCU | 1830 |
| 325 | AGUUCUUC C AUCUGACU | 1332 | AGUCAGAU CUGAUGAGGCCGUUAGGCCGAA IAAGAACU | 1831 |
| 326 | GUUCUUCC A UCUGACUC | 1333 | GAGUCAGA CUGAUGAGGCCGUUAGGCCGAA IGAAGAAC | 1832 |
| 329 | CUUCCAUC U GACUCAGG | 1334 | CCUGAGUC CUGAUGAGGCCGUUAGGCCGAA IAUGGAAG | 1833 |
| 333 | CAUCUGAC U CAGGUUUG | 1335 | CAAACCUG CUGAUGAGGCCGUUAGGCCGAA IUCAGAUG | 1834 |
| 335 | UCUGACUC A GGUUUGCU | 1336 | AGCAAACC CUGAUGAGGCCGUUAGGCCGAA IAGUCAGA | 1835 |
| 343 | AGGUUUGC U UCUCUGGC | 1337 | GCCAGAGA CUGAUGAGGCCGUUAGGCCGAA ICAAACCU | 1836 |
| 346 | UUUGCUUC U CUGGCGGU | 1338 | ACCGCCAG CUGAUGAGGCCGUUAGGCCGAA IAAGCAAA | 1837 |
| 348 | UGCUUCUC U GGCGGUCU | 1339 | AGACCGCC CUGAUGAGGCCGUUAGGCCGAA IAGAAGCA | 1838 |
| 356 | UGGCGGUC U UCAGAAUC | 1340 | GAUUCUGA CUGAUGAGGCCGUUAGGCCGAA IACCGCCA | 1839 |
| 359 | CGGUCUUC U GAAUCAC | 1341 | GUUGAUUC CUGAUGAGGCCGUUAGGCCGAA IAAGACCG | 1840 |
| 365 | UCAGAAUC A ACAUCCAC | 1342 | GUGGAUGU CUGAUGAGGCCGUUAGGCCGAA IAUUCUGA | 1841 |
| 368 | GAAUCAAC A UCCACACU | 1343 | AGUGUGGA CUGAUGAGGCCGUUAGGCCGAA IUUGAUUC | 1842 |
| 371 | UCAACAUC C ACACUUCC | 1344 | GGAAGUGU CUGAUGAGGCCGUUAGGCCGAA IAUGUUGA | 1843 |
| 372 | CAACAUCC A CACUUCCG | 1345 | CGGAAGUG CUGAUGAGGCCGUUAGGCCGAA IGAUGUUG | 1844 |

TABLE IX-continued

Human PKR Inozyme and Substrate Sequence

| Pos | Substrate | Seq ID | Inozyme | Seq ID |
|---|---|---|---|---|
| 374 | ACAUCCAC A CUUCCGUG | 1346 | CACGGAAG CUGAUGAGGCCGUUAGGCCGAA IUGGAUGU | 1845 |
| 376 | AUCCACAC U UCCGUGAU | 1347 | AUCACGGA CUGAUGAGGCCGUUAGGCCGAA IUGUGGAU | 1846 |
| 379 | CACACUUC C GUGAUUAU | 1348 | AUAAUCAC CUGAUGAGGCCGUUAGGCCGAA IAAGUGUG | 1847 |
| 389 | UGAUUAUC U GCGUGCAU | 1349 | AUGCACGC CUGAUGAGGCCGUUAGGCCGAA IAUAAUCA | 1848 |
| 396 | CUGCGUGC A UUUUGGAC | 1350 | GUCCAAAA CUGAUGAGGCCGUUAGGCCGAA ICACGCAG | 1849 |
| 405 | UUUUGGAC A AAGCUUCC | 1351 | GGAAGCUU CUGAUGAGGCCGUUAGGCCGAA IUCCAAAA | 1850 |
| 410 | GACAAAGC U UCCAACCA | 1352 | UGGUUGGA CUGAUGAGGCCGUUAGGCCGAA ICUUUGUC | 1851 |
| 413 | AAAGCUUC C AACCAGGA | 1353 | UCCUGGUU CUGAUGAGGCCGUUAGGCCGAA IAAGCUUU | 1852 |
| 414 | AAGCUUCC A ACCAGGAU | 1354 | AUCCUGGU CUGAUGAGGCCGUUAGGCCGAA IGAAGCUU | 1853 |
| 417 | CUUCCAAC C AGGAUACG | 1355 | CGUAUCCU CUGAUGAGGCCGUUAGGCCGAA IUUGGAAG | 1854 |
| 418 | UUCCAACC A GGAUACGG | 1356 | CCGUAUCC CUGAUGAGGCCGUUAGGCCGAA IGUUGGAA | 1855 |
| 441 | GAAAUGGC U GGUGAUCU | 1357 | AGAUCACC CUGAUGAGGCCGUUAGGCCGAA ICCAUUUC | 1856 |
| 449 | UGGUGAUC U UUCAGCAG | 1358 | CUGCUGAA CUGAUGAGGCCGUUAGGCCGAA IAUCACCA | 1857 |
| 453 | GAUCUUUC A GCAGGUUU | 1359 | AAACCUGC CUGAUGAGGCCGUUAGGCCGAA IAAAGAUC | 1858 |
| 456 | CUUUCAGC A GGUUUCUU | 1360 | AAGAAACC CUGAUGAGGCCGUUAGGCCGAA ICUGAAAG | 1859 |
| 463 | CAGGUUUC U UCAUGGAG | 1361 | CUCCAUGA CUGAUGAGGCCGUUAGGCCGAA IAAACCUG | 1860 |
| 466 | GUUUCUUC A UGGAGGAA | 1362 | UUCCUCCA CUGAUGAGGCCGUUAGGCCGAA IAAGAAAC | 1861 |
| 476 | GGAGGAAC U UAAUACAU | 1363 | AUGUAUUA CUGAUGAGGCCGUUAGGCCGAA IUUCCUCC | 1862 |
| 483 | CUUAAUAC A UACCGUCA | 1364 | UGACGGUA CUGAUGAGGCCGUUAGGCCGAA IUAUUAAG | 1863 |
| 487 | AUACAUAC C GUCAGAAG | 1365 | CUUCUGAC CUGAUGAGGCCGUUAGGCCGAA IUAUGUAU | 1864 |
| 491 | AUACCGUC A GAAGCAGG | 1366 | CCUGCUUC CUGAUGAGGCCGUUAGGCCGAA IACGGUAU | 1865 |
| 497 | UCAGAAGC A GGGAGUAG | 1367 | CUACUCCC CUGAUGAGGCCGUUAGGCCGAA ICUUCUGA | 1866 |
| 509 | AGUAGUAC U UAAAUAUC | 1368 | GAUAUUUA CUGAUGAGGCCGUUAGGCCGAA IUACUACU | 1867 |
| 518 | UAAAUAUC A AGAACUGC | 1369 | GCAGUUCU CUGAUGAGGCCGUUAGGCCGAA IAUAUUUA | 1868 |
| 524 | UCAAGAAC U GCCUAAUU | 1370 | AAUUAGGC CUGAUGAGGCCGUUAGGCCGAA IUUCUUGA | 1869 |
| 527 | AGAACUGC C UAAUUCAG | 1371 | CUGAAUUA CUGAUGAGGCCGUUAGGCCGAA ICAGUUCU | 1870 |
| 528 | GAACUGCC U AAUUCAGG | 1372 | CCUGAAUU CUGAUGAGGCCGUUAGGCCGAA IGCAGUUC | 1871 |
| 534 | CCUAAUUC A GGACCUCC | 1373 | GGAGGUCC CUGAUGAGGCCGUUAGGCCGAA IAAUUAGG | 1872 |
| 539 | UUCAGGAC C UCCACAUG | 1374 | CAUGUGGA CUGAUGAGGCCGUUAGGCCGAA IUCCUGAA | 1873 |
| 540 | UCAGGACC U CCACAUGA | 1375 | UCAUGUGG CUGAUGAGGCCGUUAGGCCGAA IGUCCUGA | 1874 |
| 542 | AGGACCUC C ACAUGAUA | 1376 | UAUCAUGU CUGAUGAGGCCGUUAGGCCGAA IAGGUCCU | 1875 |
| 543 | GGACCUCC A CAUGAUAG | 1377 | CUAUCAUG CUGAUGAGGCCGUUAGGCCGAA IGAGGUCC | 1876 |
| 545 | ACCUCCAC A UGAUAGGA | 1378 | UCCUAUCA CUGAUGAGGCCGUUAGGCCGAA IUGGAGGU | 1877 |
| 561 | AGGUUUAC A UUUCAAGU | 1379 | ACUUGAAA CUGAUGAGGCCGUUAGGCCGAA IUAAACCU | 1878 |
| 566 | UACAUUUC A AGUUAUAA | 1380 | UUAUAACU CUGAUGAGGCCGUUAGGCCGAA IAAAUGUA | 1879 |
| 593 | AGAAUUUC C AGAAGGUG | 1381 | CACCUUCU CUGAUGAGGCCGUUAGGCCGAA IAAAUUCU | 1880 |
| 594 | GAAUUUCC A GAAGGUGA | 1382 | UCACCUUC CUGAUGAGGCCGUUAGGCCGAA IGAAAUUC | 1881 |
| 612 | GGUAGAUC A AAGAAGGA | 1383 | UCCUUCUU CUGAUGAGGCCGUUAGGCCGAA IAUCUACC | 1882 |
| 624 | AAGGAAGC A AAAAAUGC | 1384 | GCAUUUUU CUGAUGAGGCCGUUAGGCCGAA ICUUCCUU | 1883 |
| 633 | AAAAAUGC C GCAGCCAA | 1385 | UUGGCUGC CUGAUGAGGCCGUUAGGCCGAA ICAUUUUU | 1884 |
| 636 | AAUGCCGC A GCCAAAUU | 1386 | AAUUUGGC CUGAUGAGGCCGUUAGGCCGAA ICGGCAUU | 1885 |
| 639 | GCCGCAGC C AAAUUAGC | 1387 | GCUAAUUU CUGAUGAGGCCGUUAGGCCGAA ICUGCGGC | 1886 |
| 640 | CCGCAGCC A AAUUAGCU | 1388 | AGCUAAUU CUGAUGAGGCCGUUAGGCCGAA IGCUGCGG | 1887 |
| 648 | AAAUUAGC U GUUGAGAU | 1389 | AUCUCAAC CUGAUGAGGCCGUUAGGCCGAA ICUAAUUU | 1888 |
| 659 | UGAGAUAC U UAAUAAGG | 1390 | CCUUAUUA CUGAUGAGGCCGUUAGGCCGAA IUAUCUCA | 1889 |
| 678 | AAGAAGGC A GUUAGUCC | 1391 | GGACUAAC CUGAUGAGGCCGUUAGGCCGAA ICCUUCUU | 1890 |
| 686 | AGUUAGUC C UUUAUUAU | 1392 | AUAAUAAA CUGAUGAGGCCGUUAGGCCGAA IACUAACU | 1891 |
| 687 | GUUAGUCC U UUAUUAUU | 1393 | AAUAAUAA CUGAUGAGGCCGUUAGGCCGAA IGACUAAC | 1892 |
| 699 | UUAUUGAC A ACAACGAA | 1394 | UUCGUUGU CUGAUGAGGCCGUUAGGCCGAA IUCAAUAA | 1893 |
| 702 | UUGACAAC A ACGAAUUC | 1395 | GAAUUCGU CUGAUGAGGCCGUUAGGCCGAA IUUGUCAA | 1894 |
| 711 | ACGAAUUC U UCAGAAGG | 1396 | CCUUCUGA CUGAUGAGGCCGUUAGGCCGAA IAAUUCGU | 1895 |
| 714 | AAUUCUUC A GAAGGAUU | 1397 | AAUCCUUC CUGAUGAGGCCGUUAGGCCGAA IAAGAAUU | 1896 |
| 726 | GGAUUAUC C AUGGGAAA | 1398 | UUCCCAUU CUGAUGAGGCCGUUAGGCCGAA IAUAAUCC | 1897 |
| 727 | GAUUAUCC A UGGGGAAU | 1399 | AUUCCCCA CUGAUGAGGCCGUUAGGCCGAA IGAUAAUC | 1898 |
| 739 | GGAUUAC A UAGGCCUU | 1400 | AAGGCCUA CUGAUGAGGCCGUUAGGCCGAA IUAAUUCC | 1899 |
| 745 | ACAUAGGC C UUAUCAUU | 1401 | AUUGAUAA CUGAUGAGGCCGUUAGGCCGAA ICCUAUGU | 1900 |
| 746 | CAUAGGCC U UAUCAUAA | 1402 | UAUUGAUA CUGAUGAGGCCGUUAGGCCGAA IGCCUAUG | 1901 |
| 751 | GCCUUAUC A UAGAAUU | 1403 | AAUUCUAU CUGAUGAGGCCGUUAGGCCGAA IAUAAGGC | 1902 |
| 762 | AGAAUUGC C CAGAAGAA | 1404 | UUCUUCUG CUGAUGAGGCCGUUAGGCCGAA ICAAUUCU | 1903 |
| 763 | GAAUUGCC C AGAAGAAA | 1405 | UUUCUUCU CUGAUGAGGCCGUUAGGCCGAA IGCAAUUC | 1904 |
| 764 | AAUUGCCC A GAAGAAAA | 1406 | UUUUCUUC CUGAUGAGGCCGUUAGGCCGAA IGGCAAUU | 1905 |
| 776 | GAAAAGAC U AACUGUAA | 1407 | UUACAGUU CUGAUGAGGCCGUUAGGCCGAA IUCUUUUC | 1906 |
| 780 | AGACUAAC U GUAAAUUA | 1408 | UAAUUUAC CUGAUGAGGCCGUUAGGCCGAA IUUAGUCU | 1907 |
| 794 | UUAUGAAC A GUGUGCAU | 1409 | AUGCACAC CUGAUGAGGCCGUUAGGCCGAA IUUCAUAA | 1908 |
| 801 | CAGUGUGC A UCGGGGGU | 1410 | ACCCCCGA CUGAUGAGGCCGUUAGGCCGAA ICACACUG | 1909 |
| 812 | GGGGGUGC A UGGGCCAG | 1411 | CUGGCCCA CUGAUGAGGCCGUUAGGCCGAA ICACCCCC | 1910 |
| 818 | GCAUGGGC C AGAAGGAU | 1412 | AUCCUUCU CUGAUGAGGCCGUUAGGCCGAA ICCCAUGC | 1911 |
| 819 | CAUGGGCC A GAAGGAUU | 1413 | AAUCCUUC CUGAUGAGGCCGUUAGGCCGAA IGCCCAUG | 1912 |
| 830 | AGGAUUUC A UUAUAAAU | 1414 | AUUUAUAA CUGAUGAGGCCGUUAGGCCGAA IAAAUCCU | 1913 |
| 841 | AUAAAUGC A AAAUGGGA | 1415 | UCCCAUUU CUGAUGAGGCCGUUAGGCCGAA ICAUUUAU | 1914 |
| 851 | AAUGGGAC A GAAAGAAU | 1416 | AUUCUUUC CUGAUGAGGCCGUUAGGCCGAA IUCCCAUU | 1915 |
| 873 | AUUGGUAC A GGUUCUAC | 1417 | GUAGAACC CUGAUGAGGCCGUUAGGCCGAA IACCAAU | 1916 |
| 879 | ACAGGUUC U ACAAACA | 1418 | UGUUUAGU CUGAUGAGGCCGUUAGGCCGAA IAACCUGU | 1917 |
| 882 | GGUUCUAC U AAACAGGA | 1419 | UCCUGUUU CUGAUGAGGCCGUUAGGCCGAA IUAGAACC | 1918 |
| 887 | UACUAAAC A GGAAGCAA | 1420 | UUGCUUCC CUGAUGAGGCCGUUAGGCCGAA IUUUAGUA | 1919 |

TABLE IX-continued

Human PKR Inozyme and Substrate Sequence

| Pos | Substrate | Seq ID | Inozyme | Seq ID |
|---|---|---|---|---|
| 894 | CAGGAAGC A AAACAAUU | 1421 | AAUUGUUU CUGAUGAGGCCGUUAGGCCGAA ICUUCCUG | 1920 |
| 899 | AGCAAAAC A AUUGGCCG | 1422 | CGGCCAAU CUGAUGAGGCCGUUAGGCCGAA IUUUUGCU | 1921 |
| 906 | CAAUUGGC C GCUAAACU | 1423 | AGUUUAGC CUGAUGAGGCCGUUAGGCCGAA ICCAAUUG | 1922 |
| 909 | UUGGCCGC U AAACUUGC | 1424 | GCAAGUUU CUGAUGAGGCCGUUAGGCCGAA ICGGCCAA | 1923 |
| 914 | CGCUAAAC U UGCAUAUC | 1425 | GAUAUGCA CUGAUGAGGCCGUUAGGCCGAA IUUUAGCG | 1924 |
| 918 | AAACUUGC A UAUCUUCA | 1426 | UGAAGAUA CUGAUGAGGCCGUUAGGCCGAA ICAAGUUU | 1925 |
| 923 | UGCAUAUC U UCAGAUAU | 1427 | AUAUCUGA CUGAUGAGGCCGUUAGGCCGAA IAUAUGCA | 1926 |
| 926 | AUAUCUUC A GAUAUUAU | 1428 | AUAAUAUC CUGAUGAGGCCGUUAGGCCGAA IAAGAUAU | 1927 |
| 936 | AUAUUAUC A GAAGAAAC | 1429 | GUUUCUUC CUGAUGAGGCCGUUAGGCCGAA IAUAAUAU | 1928 |
| 945 | GAAGAAAC C UCAGUGAA | 1430 | UUCACUGA CUGAUGAGGCCGUUAGGCCGAA IUUUCUUC | 1929 |
| 946 | AAGAAACC U CAGUGAAA | 1431 | UUUCACUG CUGAUGAGGCCGUUAGGCCGAA IGUUUCUU | 1930 |
| 948 | GAAACCUC A GUGAAAUC | 1432 | GAUUUCAC CUGAUGAGGCCGUUAGGCCGAA IAGGUUUC | 1931 |
| 957 | GUGAAAUC U GACUACCU | 1433 | AGGUAGUC CUGAUGAGGCCGUUAGGCCGAA IAUUUCAC | 1932 |
| 961 | AAUCUGAC U ACCUGUCC | 1434 | GGACAGGU CUGAUGAGGCCGUUAGGCCGAA IUCAGAUU | 1933 |
| 964 | CUGACUAC C UGUCCUCU | 1435 | AGAGGACA CUGAUGAGGCCGUUAGGCCGAA IUAGUCAG | 1934 |
| 965 | UGACUACC U GUCCUCUG | 1436 | CAGAGGAC CUGAUGAGGCCGUUAGGCCGAA IGUAGUCA | 1935 |
| 969 | UACCUGUC C UCGGUUCU | 1437 | GAACCAGA CUGAUGAGGCCGUUAGGCCGAA IACAGGUA | 1936 |
| 970 | ACCUGUCC U CGGUUCUU | 1438 | AGAACCAG CUGAUGAGGCCGUUAGGCCGAA IGACAGGU | 1937 |
| 972 | CUGUCCUC U GGUUCUUU | 1439 | AAAGAACC CUGAUGAGGCCGUUAGGCCGAA IAGGACAG | 1938 |
| 978 | UCGGUUCU U UUUGCUAC | 1440 | GUAGCAAA CUGAUGAGGCCGUUAGGCCGAA IAACCAGA | 1939 |
| 984 | UCUUUUGC U ACUACGUG | 1441 | CACGUAGU CUGAUGAGGCCGUUAGGCCGAA ICAAAAGA | 1940 |
| 987 | UUUGCUAC U ACGUGUGA | 1442 | UCACACGU CUGAUGAGGCCGUUAGGCCGAA IUAGCAAA | 1941 |
| 999 | UGUGAGUC C AAAGCAAC | 1443 | UUGCUUUG CUGAUGAGGCCGUUAGGCCGAA IACUCACA | 1942 |
| 1000 | GUGAGUCC C AAAGCAAC | 1444 | GUUGCUUU CUGAUGAGGCCGUUAGGCCGAA IGACUCAC | 1943 |
| 1001 | UGAGUCCC A AAGCAACU | 1445 | AGUUGCUU CUGAUGAGGCCGUUAGGCCGAA IGGACUCA | 1944 |
| 1006 | CCCAAAGC A ACUCUUUA | 1446 | UAAAGAGU CUGAUGAGGCCGUUAGGCCGAA ICUUUGGG | 1945 |
| 1009 | AAAGCAAC U CUUUAGUG | 1447 | CACUAAAG CUGAUGAGGCCGUUAGGCCGAA IUUGCUUU | 1946 |
| 1011 | AGCAACUC U UUAGUGAC | 1448 | GUCACUAA CUGAUGAGGCCGUUAGGCCGAA IAGUUGCU | 1947 |
| 1020 | UUAGUGAC A AGCACACU | 1449 | AGUGUGCU CUGAUGAGGCCGUUAGGCCGAA IUCACUAA | 1948 |
| 1021 | UAGUGACC A GCACACUC | 1450 | GAGUGUGC CUGAUGAGGCCGUUAGGCCGAA IGUCACUA | 1949 |
| 1024 | UGACCAGC A CACUCGCU | 1451 | AGCGAGUG CUGAUGAGGCCGUUAGGCCGAA ICUGGUCA | 1950 |
| 1026 | ACCAGCAC A CUCGCUUC | 1452 | GAAGCGAG CUGAUGAGGCCGUUAGGCCGAA IUGCUGGU | 1951 |
| 1028 | CAGCACAC U CGCUUCUG | 1453 | CAGAAGCG CUGAUGAGGCCGUUAGGCCGAA IUGUGCUG | 1952 |
| 1032 | ACACUCGC U UCUGAAUC | 1454 | GAUUCAGA CUGAUGAGGCCGUUAGGCCGAA ICGAGUGU | 1953 |
| 1035 | CUCGCUUC U GAAUCAUC | 1455 | GAUGAUUC CUGAUGAGGCCGUUAGGCCGAA IAAGCGAG | 1954 |
| 1041 | UCUGAAUC A UCAUCUGA | 1456 | UCAGAUGA CUGAUGAGGCCGUUAGGCCGAA IAUUCAGA | 1955 |
| 1044 | GAAUCAUC A UCUGAAGG | 1457 | CCUUCAGA CUGAUGAGGCCGUUAGGCCGAA IAUGAUUC | 1956 |
| 1047 | UCAUCAUC U GAAGGUGA | 1458 | UCACCUUC CUGAUGAGGCCGUUAGGCCGAA IAUGAUGA | 1957 |
| 1057 | AAGGUGAC U UCUCAGCA | 1459 | UGCUGAGA CUGAUGAGGCCGUUAGGCCGAA IUCACCUU | 1958 |
| 1060 | GUGACUUC U CAGCAGAU | 1460 | AUCUGCUG CUGAUGAGGCCGUUAGGCCGAA IAAGUCAC | 1959 |
| 1062 | GACUUCUC A GCAGAUAC | 1461 | GUAUCUGC CUGAUGAGGCCGUUAGGCCGAA IAGAAGUC | 1960 |
| 1065 | UUCUCAGC A GAUACAUC | 1462 | GAUGUAUC CUGAUGAGGCCGUUAGGCCGAA ICUGAGAA | 1961 |
| 1071 | GCAGAUAC A UCAGAGAU | 1463 | AUCUCUGA CUGAUGAGGCCGUUAGGCCGAA IUAUCUGC | 1962 |
| 1074 | GAUACAUC A GAGAUAAA | 1464 | UUUAUCUC CUGAUGAGGCCGUUAGGCCGAA IAUGUAUC | 1963 |
| 1086 | AUAAAUUC A AACAGUGA | 1465 | UCACUGUU CUGAUGAGGCCGUUAGGCCGAA IAAUUUAU | 1964 |
| 1090 | AUUCUAAC A GUGACAGU | 1466 | ACUGUCAC CUGAUGAGGCCGUUAGGCCGAA IUUAGAAU | 1965 |
| 1096 | ACAGUGAC A GUUUAAAC | 1467 | GUUUAAAC CUGAUGAGGCCGUUAGGCCGAA IUCACUGU | 1966 |
| 1105 | GUUUAAAC A GUUCUUCG | 1468 | CGAAGAAC CUGAUGAGGCCGUUAGGCCGAA IUUUAAAC | 1967 |
| 1110 | AACAGUUC U UCGUUGCU | 1469 | AGCAACGA CUGAUGAGGCCGUUAGGCCGAA IAACUGUU | 1968 |
| 1118 | UUCGUUGC U UAUGAAUA | 1470 | CAUUCAUA CUGAUGAGGCCGUUAGGCCGAA ICAACGAA | 1969 |
| 1130 | GAAUGGUC U CAGAAAUA | 1471 | UAUUUCUG CUGAUGAGGCCGUUAGGCCGAA IACCAUUC | 1970 |
| 1132 | AUGGUCUC U GAAAUAAU | 1472 | AUUAUUUC CUGAUGAGGCCGUUAGGCCGAA IAGACCAU | 1971 |
| 1142 | AAAUAAUC A AAGGAAGG | 1473 | CCUUCCUU CUGAUGAGGCCGUUAGGCCGAA IAUUAUUU | 1972 |
| 1152 | AGGAAGGC A AAAAGAUC | 1474 | GAUCUUUU CUGAUGAGGCCGUUAGGCCGAA ICCUUCCU | 1973 |
| 1161 | AAAAGAUC U UGGCACC | 1475 | GGUGCCAA CUGAUGAGGCCGUUAGGCCGAA IAUCUUUU | 1974 |
| 1167 | UCUUUGGC A CCCAGAUU | 1476 | AAUCUGGG CUGAUGAGGCCGUUAGGCCGAA ICCAAAGA | 1975 |
| 1169 | UUUGGCAC C CAGAUUUG | 1477 | CAAAUCUG CUGAUGAGGCCGUUAGGCCGAA IUGCCAAA | 1976 |
| 1170 | UUGGCACC C AGAUUUGA | 1478 | UCAAAUCU CUGAUGAGGCCGUUAGGCCGAA IGUGCCAA | 1977 |
| 1171 | UGGCACCC A GAUUUGAC | 1479 | GUCAAAUC CUGAUGAGGCCGUUAGGCCGAA IGGUGCCA | 1978 |
| 1180 | GAUUUGAC C UUCCUGAC | 1480 | GUCAGGAA CUGAUGAGGCCGUUAGGCCGAA ICAAAUC | 1979 |
| 1181 | AUUUGACC U UCCUGACA | 1481 | UGUCAGGA CUGAUGAGGCCGUUAGGCCGAA IGUCAAAU | 1980 |
| 1184 | UGACCUUC C UGACAUGA | 1482 | UCAUGUCA CUGAUGAGGCCGUUAGGCCGAA IAAGGUCA | 1981 |
| 1185 | GACCUUCC U GACAUGAA | 1483 | UUCAUGUC CUGAUGAGGCCGUUAGGCCGAA IGAAGGUC | 1982 |
| 1189 | UUCCUGAC A UGAAAGAA | 1484 | UUCUUUCA CUGAUGAGGCCGUUAGGCCGAA ICAGGAA | 1983 |
| 1200 | AAAGAAAC A AGUAUAC | 1485 | GUAUACUU CUGAUGAGGCCGUUAGGCCGAA IUUUCUUU | 1984 |
| 1209 | AAGUAUAC U GGGACAA | 1486 | UUGUCCAC CUGAUGAGGCCGUUAGGCCGAA IUAUACUU | 1985 |
| 1216 | CUGUGGAC A AGAGGUUU | 1487 | AAACCUCU CUGAUGAGGCCGUUAGGCCGAA IUCCACAG | 1986 |
| 1228 | GGUUUGGC U UGGAUUUU | 1488 | AAAAUCCA CUGAUGAGGCCGUUAGGCCGAA ICCAAACC | 1987 |
| 1258 | UAAUUGGC U CAGGUGGA | 1489 | UCCACCUG CUGAUGAGGCCGUUAGGCCGAA ICCAAUUA | 1988 |
| 1260 | AUUGGCUC A GGUGGAUU | 1490 | AAUCCACC CUGAUGAGGCCGUUAGGCCGAA IAGCCAAU | 1989 |
| 1273 | GAUUUGGC C AAGUUUC | 1491 | GAAACUUU CUGAUGAGGCCGUUAGGCCGAA ICCAAAUC | 1990 |
| 1274 | AUUUGGCC A AGUUUCA | 1492 | UGAAACUU CUGAUGAGGCCGUUAGGCCGAA IGCCAAAU | 1991 |
| 1282 | AAGUUUC A AAGCAAA | 1493 | UUUUGCUU CUGAUGAGGCCGUUAGGCCGAA IAAAACUU | 1992 |
| 1287 | UUCAAAGC A AAACACAG | 1494 | CUGUGUUU CUGAUGAGGCCGUUAGGCCGAA ICUUUGAA | 1993 |
| 1292 | AGCAAAAC A CAGAAUUG | 1495 | CAAUUCUG CUGAUGAGGCCGUUAGGCCGAA IUUUUGCU | 1994 |

TABLE IX-continued

Human PKR Inozyme and Substrate Sequence

| Pos | Substrate | Seq ID | Inozyme | Seq ID |
|---|---|---|---|---|
| 1294 | CAAAACAC A GAAUUGAC | 1496 | GUCAAUUC CUGAUGAGGCCGUUAGGCCGAA IGUUUUG | 1995 |
| 1311 | GGAAAGAC U UACGUUAU | 1497 | AUAACGUA CUGAUGAGGCCGUUAGGCCGAA IUCUUUCC | 1996 |
| 1368 | GUAAAAGC A UUGGCAAA | 1498 | UUUGCCAA CUGAUGAGGCCGUUAGGCCGAA ICUUUUAC | 1997 |
| 1374 | GCAUUGGC A AAACUUGA | 1499 | UCAAGUUU CUGAUGAGGCCGUUAGGCCGAA ICCAAUGC | 1998 |
| 1379 | GGCAAAAC U UGAUCAUG | 1500 | CAUGAUCA CUGAUGAGGCCGUUAGGCCGAA IUUUUGCC | 1999 |
| 1385 | ACUUGAUC A UGUAAAUA | 1501 | UAUUUACA CUGAUGAGGCCGUUAGGCCGAA IAUCAAGU | 2000 |
| 1400 | UAUUGUUC A CUACAAUG | 1502 | CAUUGUAG CUGAUGAGGCCGUUAGGCCGAA IAACAAUA | 2001 |
| 1402 | UUGUUCAC U ACAAUGGC | 1503 | GCCAUUGU CUGAUGAGGCCGUUAGGCCGAA IUGAACAA | 2002 |
| 1405 | UUCACUAC A AUGGCUGU | 1504 | ACAGCCAU CUGAUGAGGCCGUUAGGCCGAA IUAGUGAA | 2003 |
| 1411 | ACAAUGGC U GUUGGGAU | 1505 | AUCCCAAC CUGAUGAGGCCGUUAGGCCGAA ICCAUUGU | 2004 |
| 1436 | UUAUGAUC C UGAGACCA | 1506 | UGGUCUCA CUGAUGAGGCCGUUAGGCCGAA IAUCAUAA | 2005 |
| 1437 | UAUGAUCC U GAGACCAG | 1507 | CUGGUCUC CUGAUGAGGCCGUUAGGCCGAA IGAUCAUA | 2006 |
| 1443 | CCUGAGAC C AGUGAUGA | 1508 | UCAUCACU CUGAUGAGGCCGUUAGGCCGAA IUCUCAGG | 2007 |
| 1444 | CUGAGACC A GUGAUGAU | 1509 | AUCAUCAC CUGAUGAGGCCGUUAGGCCGAA IGUCUCAG | 2008 |
| 1455 | GAUGAUUC U CUUGAGAG | 1510 | CUCUCAAG CUGAUGAGGCCGUUAGGCCGAA IAAUCAUC | 2009 |
| 1457 | UGAUUCUC U UGAGAGCA | 1511 | UGCUCUCA CUGAUGAGGCCGUUAGGCCGAA IAGAAUCA | 2010 |
| 1465 | UUGAGAGC A GUGAUUAU | 1512 | AUAAUCAC CUGAUGAGGCCGUUAGGCCGAA ICUCUCAA | 2011 |
| 1478 | UUAUGAUC C UGAGAACA | 1513 | UGUUCUCA CUGAUGAGGCCGUUAGGCCGAA IAUCAUAA | 2012 |
| 1479 | UAUGAUCC U GAGAACAG | 1514 | CUGUCCUC CUGAUGAGGCCGUUAGGCCGAA IGAUCAUA | 2013 |
| 1486 | CUGAGAAC A GCAAAAAU | 1515 | AUUUUUGC CUGAUGAGGCCGUUAGGCCGAA IUUCUCAG | 2014 |
| 1489 | AGAACAGC A AAAUAGU | 1516 | ACUAUUUU CUGAUGAGGCCGUUAGGCCGAA ICUGUUCU | 2015 |
| 1500 | AAUAGUUC A AGGUCAAA | 1517 | UUUGACCU CUGAUGAGGCCGUUAGGCCGAA IAACUAUU | 2016 |
| 1506 | UCAAGGUC A AAGACUAA | 1518 | UUAGUCUU CUGAUGAGGCCGUUAGGCCGAA IACCUUGA | 2017 |
| 1512 | UCAAAGAC U AAGUGCCU | 1519 | AGGCACUU CUGAUGAGGCCGUUAGGCCGAA IUCUUUGA | 2018 |
| 1519 | CUAAGUGC C UUUUCAUC | 1520 | GAUGAAAA CUGAUGAGGCCGUUAGGCCGAA ICACUUAG | 2019 |
| 1520 | UAAGUGCC U UUUCAUCC | 1521 | GGAUGAAA CUGAUGAGGCCGUUAGGCCGAA IGCACUUA | 2020 |
| 1525 | GCCUUUUC A UCCAAAUG | 1522 | CAUUUGGA CUGAUGAGGCCGUUAGGCCGAA IAAAAGGC | 2021 |
| 1528 | UUUUCAUC C AAAUGAA | 1523 | UUCCAUUU CUGAUGAGGCCGUUAGGCCGAA IAUGAAAA | 2022 |
| 1529 | UUUCAUCC A AAUGGAAU | 1524 | AUUCCAUU CUGAUGAGGCCGUUAGGCCGAA IGAUGAAA | 2023 |
| 1540 | UGGAAUUC U GUGAUAAA | 1525 | UUUAUCAC CUGAUGAGGCCGUUAGGCCGAA IAAUUCCA | 2024 |
| 1554 | AAAGGGAC C UUGGAACA | 1526 | UGUUCCAA CUGAUGAGGCCGUUAGGCCGAA IUCCCUUU | 2025 |
| 1555 | AAGGGACC U UGGAACAA | 1527 | UUGUUCCA CUGAUGAGGCCGUUAGGCCGAA IGUCCCUU | 2026 |
| 1562 | CUUGGAAC A AUGGAUUG | 1528 | CAAUCCAU CUGAUGAGGCCGUUAGGCCGAA IUUCCAAG | 2027 |
| 1592 | CGAGAAAC U AGACAAAG | 1529 | CUUUGUCU CUGAUGAGGCCGUUAGGCCGAA IUUUCUCG | 2028 |
| 1597 | AACUAGAC A AAGUUUUG | 1530 | CAAAACUU CUGAUGAGGCCGUUAGGCCGAA IUCUAGUU | 2029 |
| 1608 | GUUUUGGC U UUGGAACU | 1531 | AGUUCCAA CUGAUGAGGCCGUUAGGCCGAA ICCAAAAC | 2030 |
| 1616 | UUUGGAAC U CUUGAAC | 1532 | GUUCAAAG CUGAUGAGGCCGUUAGGCCGAA IUUCCAAA | 2031 |
| 1618 | UGGAACUC U UUGAACAA | 1533 | UUGUUCAA CUGAUGAGGCCGUUAGGCCGAA IAGUUCCA | 2032 |
| 1625 | CUUUGAAC A AAUAACAA | 1534 | UUGUUAUU CUGAUGAGGCCGUUAGGCCGAA IUUCAAAG | 2033 |
| 1632 | CAAAUAAC A AAAGGGGU | 1535 | ACCCCUUU CUGAUGAGGCCGUUAGGCCGAA IUUAUUUG | 2034 |
| 1652 | UAUAUAC A UUCAAAAA | 1536 | UUUUUGAA CUGAUGAGGCCGUUAGGCCGAA IUAUAUAA | 2035 |
| 1656 | AUACAUUC A AAAAAUU | 1537 | AAUUUUUU CUGAUGAGGCCGUUAGGCCGAA IAAUGUAU | 2036 |
| 1670 | AUUAAUUC A UAGAGAUC | 1538 | GAUCUCUA CUGAUGAGGCCGUUAGGCCGAA IAAUUAUU | 2037 |
| 1679 | UAGAGAUC U UAAGCCAA | 1539 | UUGGCUUA CUGAUGAGGCCGUUAGGCCGAA IAUCUCUA | 2038 |
| 1685 | UCUUAAGC C AAGUAAUA | 1540 | UAUUACUU CUGAUGAGGCCGUUAGGCCGAA ICUUAAGA | 2039 |
| 1686 | CUUAAGCC A AGUAAUAU | 1541 | AUAUUACU CUGAUGAGGCCGUUAGGCCGAA IGCUUAAG | 2040 |
| 1699 | AUAUAUUC U UAGUAGAU | 1542 | AUCUACUA CUGAUGAGGCCGUUAGGCCGAA IAAUAUAU | 2041 |
| 1710 | GUAGAUAC A AAACAAGU | 1543 | ACUUGUUU CUGAUGAGGCCGUUAGGCCGAA IUAUCUAC | 2042 |
| 1715 | UACAAAAC A AGUAAAGA | 1544 | UCUUUACU CUGAUGAGGCCGUUAGGCCGAA IUUUUGUA | 2043 |
| 1732 | UUGGAGAC U UUGGACUU | 1545 | AAGUCCAA CUGAUGAGGCCGUUAGGCCGAA IUCUCCAA | 2044 |
| 1739 | CUUUGGAC U UGUAACAU | 1546 | AUGUUACA CUGAUGAGGCCGUUAGGCCGAA IUCCAAAG | 2045 |
| 1746 | CUUGUAAC A UCUCUGAA | 1547 | UUCAGAGA CUGAUGAGGCCGUUAGGCCGAA IUUACAAG | 2046 |
| 1749 | GUAACAUC U CUGAAAAA | 1548 | UUUUUCAG CUGAUGAGGCCGUUAGGCCGAA IAUGUUAC | 2047 |
| 1751 | AACAUCUC U GAAAAAUG | 1549 | CAUUUUUC CUGAUGAGGCCGUUAGGCCGAA IAGAUGUU | 2048 |
| 1773 | AAGCGAAC A AGGAGUAA | 1550 | UUACUCCU CUGAUGAGGCCGUUAGGCCGAA IUUCGCUU | 2049 |
| 1788 | AAGGGAAC U UUGCGAUA | 1551 | UAUCGCAA CUGAUGAGGCCGUUAGGCCGAA IUUCCCUU | 2050 |
| 1798 | UGCGAUAC A UGAGCCCA | 1552 | UGGGCUCA CUGAUGAGGCCGUUAGGCCGAA IUAUCGCA | 2051 |
| 1804 | ACAUGAGC C CAGAACAG | 1553 | CUGUUCUG CUGAUGAGGCCGUUAGGCCGAA ICUCAUGU | 2052 |
| 1805 | CAUGAGCC C AGAACAGA | 1554 | UCUGUUCU CUGAUGAGGCCGUUAGGCCGAA IGCUCAUG | 2053 |
| 1806 | AUGAGCCC A GAACAGAU | 1555 | AUCUGUUC CUGAUGAGGCCGUUAGGCCGAA IGGCUCAU | 2054 |
| 1811 | CCCAGAAC A GAUUCUU | 1556 | AAGAAAUC CUGAUGAGGCCGUUAGGCCGAA IUUCUGGG | 2055 |
| 1818 | CAGAUUUC U UCGCAAGA | 1557 | UCUUGCGA CUGAUGAGGCCGUUAGGCCGAA IAAAUCUG | 2056 |
| 1823 | UUCUUCGC A AGACUAUG | 1558 | CAUAGUCU CUGAUGAGGCCGUUAGGCCGAA ICGAAGAA | 2057 |
| 1828 | CGCAAGAC U AUGGAAAG | 1559 | CUUUCCAU CUGAUGAGGCCGUUAGGCCGAA IUCUUGCG | 2058 |
| 1846 | AAGUGGAC C UCUACGCU | 1560 | AGCGUAGA CUGAUGAGGCCGUUAGGCCGAA IUCCACUU | 2059 |
| 1847 | AGUGGACC U CUACGCUU | 1561 | AAGCGUAG CUGAUGAGGCCGUUAGGCCGAA IGUCCACU | 2060 |
| 1849 | UGGACCUC U ACGCUUUG | 1562 | CAAAGCGU CUGAUGAGGCCGUUAGGCCGAA IAGGUCCA | 2061 |
| 1854 | CUCUACGC U UUGGGCU | 1563 | AGCCCCAA CUGAUGAGGCCGUUAGGCCGAA ICGUAGAG | 2062 |
| 1862 | UUUGGGGC U AAUUCUUG | 1564 | CAAGAAUU CUGAUGAGGCCGUUAGGCCGAA ICCCCAAA | 2063 |
| 1868 | GCUAAUUC U UGCGAAC | 1565 | GUUCAGCA CUGAUGAGGCCGUUAGGCCGAA IAAUUAGC | 2064 |
| 1872 | AUUCUUGC U GAACUUCU | 1566 | AGAAGUUC CUGAUGAGGCCGUUAGGCCGAA ICAAGAAU | 2065 |
| 1877 | UGCUGAAC U UCUUCAUG | 1567 | CAUGAAGA CUGAUGAGGCCGUUAGGCCGAA IUUCAGCA | 2066 |
| 1880 | UGAACUUC U UCAUGUAU | 1568 | AUACAUGA CUGAUGAGGCCGUUAGGCCGAA IAAGUUCA | 2067 |
| 1883 | ACUUCUUC A UGUAUGUG | 1569 | CACAUACA CUGAUGAGGCCGUUAGGCCGAA IAAGAAGU | 2068 |
| 1894 | UAUGUGAC A CUGCUUUU | 1570 | AAAAGCAG CUGAUGAGGCCGUUAGGCCGAA IUCACAUA | 2069 |

TABLE IX-continued

Human PKR Inozyme and Substrate Sequence

| Pos | Substrate | Seq ID | Inozyme | Seq ID |
|---|---|---|---|---|
| 1896 | UGUGACAC U GCUUUUGA | 1571 | UCAAAAGC CUGAUGAGGCCGUUAGGCCGAA IUGUCACA | 2070 |
| 1899 | GACACUGC U UUUGAAAC | 1572 | GUUUCAAA CUGAUGAGGCCGUUAGGCCGAA ICAGUGUC | 2071 |
| 1908 | UUUGAAAC A UCAAAGUU | 1573 | AACUUUGA CUGAUGAGGCCGUUAGGCCGAA IUUUCAAA | 2072 |
| 1911 | GAAACAUC A AAGUUUUU | 1574 | AAAAACUU CUGAUGAGGCCGUUAGGCCGAA IAUGUUUC | 2073 |
| 1921 | AGUUUUUC A CAGACCUA | 1575 | UAGGUCUG CUGAUGAGGCCGUUAGGCCGAA IAAAAACU | 2074 |
| 1923 | UUUUUCAC A GACCUACG | 1576 | CGUAGGUC CUGAUGAGGCCGUUAGGCCGAA IUGAAAAA | 2075 |
| 1927 | UCACAGAC C UACGGAUU | 1577 | AUCCCGUA CUGAUGAGGCCGUUAGGCCGAA IUCUGUGA | 2076 |
| 1928 | CACAGACC U ACGGAUG | 1578 | CAUCCCGU CUGAUGAGGCCGUUAGGCCGAA IGUCUGUG | 2077 |
| 1939 | GGGAUGGC A UCAUCUCA | 1579 | UGAGAUGA CUGAUGAGGCCGUUAGGCCGAA ICCAUCCC | 2078 |
| 1942 | AUGGCAUC A UCUCAGAU | 1580 | AUCUGAGA CUGAUGAGGCCGUUAGGCCGAA IAUGCCAU | 2079 |
| 1945 | GCAUCAUC U CAGAUAUA | 1581 | UAUAUCUG CUGAUGAGGCCGUUAGGCCGAA IAUGAUGC | 2080 |
| 1947 | AUCAUCUC A GAUAUAUU | 1582 | AAUAUAUC CUGAUGAGGCCGUUAGGCCGAA IAGAUGAU | 2081 |
| 1974 | GAAAAAAC U CUUCUACA | 1583 | UGUAGAAG CUGAUGAGGCCGUUAGGCCGAA IUUUUUUC | 2082 |
| 1976 | AAAAACUC U UCUACAGA | 1584 | UCUGUAGA CUGAUGAGGCCGUUAGGCCGAA IAGUUUUU | 2083 |
| 1979 | AACUCUUC U ACAGAAAU | 1585 | AUUUCUGU CUGAUGAGGCCGUUAGGCCGAA IAAGAGUU | 2084 |
| 1982 | UCUUCUAC A GAAAUUAC | 1586 | GUAAUUUC CUGAUGAGGCCGUUAGGCCGAA IUAGAAGA | 2085 |
| 1991 | GAAAUUAC U CUCAAAGA | 1587 | UCUUUGAG CUGAUGAGGCCGUUAGGCCGAA IUAAUUUC | 2086 |
| 1993 | AAUUACUC U CAAAGAAA | 1588 | UUUCUUUG CUGAUGAGGCCGUUAGGCCGAA IAGUAAUU | 2087 |
| 1995 | UUACUCUC A AAGAAACC | 1589 | GGUUUCUU CUGAUGAGGCCGUUAGGCCGAA IAGAGUAA | 2088 |
| 2003 | AAAGAAAC C UGAGGAUC | 1590 | GAUCCUCA CUGAUGAGGCCGUUAGGCCGAA IUUUCUUU | 2089 |
| 2004 | AAGAAACC U GAGGAUCG | 1591 | CGAUCCUC CUGAUGAGGCCGUUAGGCCGAA IGUUUCUU | 2090 |
| 2015 | GGAUCGAC C UAACACAU | 1592 | AUGUGUUA CUGAUGAGGCCGUUAGGCCGAA IUCGAUCC | 2091 |
| 2016 | GAUCGACC U AACACAUC | 1593 | GAUGUGUU CUGAUGAGGCCGUUAGGCCGAA IGUCGAUC | 2092 |
| 2020 | GACCUAAC A CAUCUGAA | 1594 | UUCAGAUG CUGAUGAGGCCGUUAGGCCGAA IUUAGGUC | 2093 |
| 2022 | CCUAACAC A UCUGAAAU | 1595 | AUUUCAGA CUGAUGAGGCCGUUAGGCCGAA IUGUUAGG | 2094 |
| 2025 | AACACAUC U GAAAUACU | 1596 | AGUAUUUC CUGAUGAGGCCGUUAGGCCGAA IAUGUGUU | 2095 |
| 2033 | UGAAAUAC U AAGGACCU | 1597 | AGGUCCUU CUGAUGAGGCCGUUAGGCCGAA IUAUCUCA | 2096 |
| 2040 | CUAAGGAC C UUGACUGU | 1598 | ACAGUCAA CUGAUGAGGCCGUUAGGCCGAA IUCCUUAG | 2097 |
| 2041 | UAAGGACC U UGACUGUG | 1599 | CACAGUCA CUGAUGAGGCCGUUAGGCCGAA IGUCCUUA | 2098 |
| 2046 | ACCUUGAC U GUGGGAA | 1600 | UUCCACAC CUGAUGAGGCCGUUAGGCCGAA IUCAAGGU | 2099 |
| 2062 | AGAAAAGC C CAGAGAAA | 1601 | UUUCUCUG CUGAUGAGGCCGUUAGGCCGAA ICUUUUCU | 2100 |
| 2063 | GAAAAGCC C AGAGAAAA | 1602 | UUUUCUCU CUGAUGAGGCCGUUAGGCCGAA IGCUUUUC | 2101 |
| 2064 | AAAAGCCC C AGAAAAA | 1603 | UUUUUCUC CUGAUGAGGCCGUUAGGCCGAA IGGCUUUU | 2102 |
| 2081 | UGAACGAC A CACAUGUU | 1604 | AACAUGUG CUGAUGAGGCCGUUAGGCCGAA IUCGUUCA | 2103 |
| 2083 | AACGACAC A CAUGUUAG | 1605 | CUAACAUG CUGAUGAGGCCGUUAGGCCGAA IUGUCGUU | 2104 |
| 2085 | CGACACAC A UGUUAGAG | 1606 | CUCUAACA CUGAUGAGGCCGUUAGGCCGAA IUGUGUCG | 2105 |
| 2095 | GUUAGAGC C CUUCUGAA | 1607 | UUCAGAAG CUGAUGAGGCCGUUAGGCCGAA ICUCUAAC | 2106 |
| 2096 | UUAGAGCC C UUCUGAAA | 1608 | UUUCAGAA CUGAUGAGGCCGUUAGGCCGAA IGCUCUAA | 2107 |
| 2097 | UAGAGCCC U UCUGAAAA | 1609 | UUUUCAGA CUGAUGAGGCCGUUAGGCCGAA IGGCUCUA | 2108 |
| 2100 | AGCCCUUC U GAAAAGU | 1610 | ACUUUUUC CUGAUGAGGCCGUUAGGCCGAA IAAGGGCU | 2109 |
| 2112 | AAAGUAUC U UGCUUCUG | 1611 | CAGAAGCA CUGAUGAGGCCGUUAGGCCGAA IAUACUUU | 2110 |
| 2113 | AAGUAUCC U GCUUCUGA | 1612 | UCAGAAGC CUGAUGAGGCCGUUAGGCCGAA IGAUACUU | 2111 |
| 2116 | UAUCCUGC U UCUGAUAU | 1613 | AUAUCAGA CUGAUGAGGCCGUUAGGCCGAA ICAGGAUA | 2112 |
| 2119 | CCUGCUUC U GAUAUGCA | 1614 | UGCAUAUC CUGAUGAGGCCGUUAGGCCGAA IAAGCAGG | 2113 |
| 2127 | UGAUAUGC A GUUUCCU | 1615 | AGGAAAAC CUGAUGAGGCCGUUAGGCCGAA ICAUAUCA | 2114 |
| 2134 | CAGUUUUC C UUAAAUUA | 1616 | UAAUUUAA CUGAUGAGGCCGUUAGGCCGAA IAAAACUG | 2115 |
| 2135 | AGUUUUCC U UAAAUUAU | 1617 | AUAAUUUA CUGAUGAGGCCGUUAGGCCGAA IGAAAACU | 2116 |
| 2145 | AAAUUAUC U AAAACUG | 1618 | CAGAUUUU CUGAUGAGGCCGUUAGGCCGAA IAUAAUUU | 2117 |
| 2152 | CUAAAAUC U GCUAGGGA | 1619 | UCCCUAGC CUGAUGAGGCCGUUAGGCCGAA IAUUUUAG | 2118 |
| 2155 | AAAUCUGC U AGGGAAUA | 1620 | UAUUCCCU CUGAUGAGGCCGUUAGGCCGAA ICAGAUUU | 2119 |
| 2166 | GGAAUAUC A AUAGAUU | 1621 | AUAUCUAU CUGAUGAGGCCGUUAGGCCGAA IAUAUUCC | 2120 |
| 2179 | AUAUUUAC C UUUUAUUU | 1622 | AAAUAAAA CUGAUGAGGCCGUUAGGCCGAA IUAAAUAU | 2121 |
| 2180 | UAUUUACC U UUUAUUUU | 1623 | AAAAUAAA CUGAUGAGGCCGUUAGGCCGAA IGUAAAUA | 2122 |
| 2197 | AAGUUUUC C UUUAAUUUU | 1624 | AAAAUUAA CUGAUGAGGCCGUUAGGCCGAA IAAACAUU | 2123 |
| 2198 | AUGUUUCC U UUAAUUUU | 1625 | AAAAUUAA CUGAUGAGGCCGUUAGGCCGAA IGAAACAU | 2124 |
| 2211 | UUUUUUAC U AUUUUAC | 1626 | GUAAAAAU CUGAUGAGGCCGUUAGGCCGAA IUAAAAAA | 2125 |
| 2220 | AUUUUUAC U AAUCUUUC | 1627 | GAAAGAUU CUGAUGAGGCCGUUAGGCCGAA IUAAAAAU | 2126 |
| 2225 | UACUAAUC U UCUGCAG | 1628 | CUGCAGAA CUGAUGAGGCCGUUAGGCCGAA IAUUAGUA | 2127 |
| 2229 | AAUCUUUC U GCAGAAAC | 1629 | GUUUCUGC CUGAUGAGGCCGUUAGGCCGAA IAAAGAUU | 2128 |
| 2232 | CUUUCUGC A GAAACAGA | 1630 | UCUGUUUC CUGAUGAGGCCGUUAGGCCGAA ICAGAAAG | 2129 |
| 2238 | GCAGAAAC A GAAAGGUU | 1631 | AACCUUUC CUGAUGAGGCCGUUAGGCCGAA IUUUCUGC | 2130 |
| 2250 | AGGUUUUC U UCUUUUG | 1632 | CAAAAAGA CUGAUGAGGCCGUUAGGCCGAA IAAAACCU | 2131 |
| 2253 | UUUUCUUC U UUUUGCUU | 1633 | AAGCAAAA CUGAUGAGGCCGUUAGGCCGAA IAAGAAAA | 2132 |
| 2260 | CUUUUUGC U UCAAAAC | 1634 | GUUUUGA CUGAUGAGGCCGUUAGGCCGAA ICAAAAAG | 2133 |
| 2263 | UUUGCUUC A AAAACAUU | 1635 | AAUGUUUU CUGAUGAGGCCGUUAGGCCGAA IAAGCAAA | 2134 |
| 2269 | UCAAAAAC A UUCUUACA | 1636 | UGUAAGAA CUGAUGAGGCCGUUAGGCCGAA IUUUUUGA | 2135 |
| 2273 | AAACAUUC U UACAUUUU | 1637 | AAAAUGUA CUGAUGAGGCCGUUAGGCCGAA IAAUGUUU | 2136 |
| 2277 | AUUCUUAC A UUUUACUU | 1638 | AAGUAAAA CUGAUGAGGCCGUUAGGCCGAA IUAAGAAU | 2137 |
| 2284 | CAUUUUAC U UUUCCUG | 1639 | CAGGAAAA CUGAUGAGGCCGUUAGGCCGAA IUAAAAUG | 2138 |
| 2290 | ACUUUUUC C UGGCUCAU | 1640 | AUGAGCCA CUGAUGAGGCCGUUAGGCCGAA IAAAAAGU | 2139 |
| 2291 | CUUUUUCC U GGCUCAUC | 1641 | GAUGAGCC CUGAUGAGGCCGUUAGGCCGAA IGAAAAAG | 2140 |
| 2295 | UUCCUGGC U CAUCUCUU | 1642 | AAGAGAUG CUGAUGAGGCCGUUAGGCCGAA ICCAGGAA | 2141 |
| 2297 | CCUGGCUC A UCUCUUA | 1643 | UAAGAGA CUGAUGAGGCCGUUAGGCCGAA IAGCCAGG | 2142 |
| 2300 | GGCUCAUC U CUUUAUUC | 1644 | GAAUAAAG CUGAUGAGGCCGUUAGGCCGAA IAUGAGCC | 2143 |
| 2302 | CUCAUCUC U UUAUUCUU | 1645 | AAGAAUAA CUGAUGAGGCCGUUAGGCCGAA IAGAUGAG | 2144 |

TABLE IX-continued

Human PKR Inozyme and Substrate Sequence

| Pos | Substrate | Seq ID | Inozyme | Seq ID |
|---|---|---|---|---|
| 2309 | CUUUAUUC U UUUUUUUU | 1646 | AAAAAAAA CUGAUGAGGCCGUUAGGCCGAA IAAUAAAG | 2145 |
| 2329 | UUAAAGAC A GAGUCUCG | 1647 | CGAGACUC CUGAUGAGGCCGUUAGGCCGAA IUCUUUAA | 2146 |
| 2335 | ACAGAGUC U CGCUCUGU | 1648 | ACAGAGCG CUGAUGAGGCCGUUAGGCCGAA IACUCUGU | 2147 |
| 2339 | AGUCUCGC U CUGUUGCC | 1649 | GGCAACAG CUGAUGAGGCCGUUAGGCCGAA ICGAGACU | 2148 |
| 2341 | UCUCGCUC U GUUGCCCA | 1650 | UGGGCAAC CUGAUGAGGCCGUUAGGCCGAA IAGCGAGA | 2149 |
| 2347 | UCUGUUGC C CAGGCUGG | 1651 | CCAGCCUG CUGAUGAGGCCGUUAGGCCGAA ICAACAGA | 2150 |
| 2348 | CUGUUGCC C AGGCUGGA | 1652 | UCCAGCCU CUGAUGAGGCCGUUAGGCCGAA IGCAACAG | 2151 |
| 2349 | UGUUGCCC A GGCUGGAG | 1653 | CUCCAGCC CUGAUGAGGCCGUUAGGCCGAA IGGCAACA | 2152 |
| 2353 | GCCCAGGC U GGAGUGCA | 1654 | UGCACUCC CUGAUGAGGCCGUUAGGCCGAA ICCUGGGC | 2153 |
| 2361 | UGGAGUGC A AUGACACA | 1655 | UGUGUCAU CUGAUGAGGCCGUUAGGCCGAA ICACUCCA | 2154 |
| 2367 | GCAAUGAC A CAGUCUUG | 1656 | CAAGACUG CUGAUGAGGCCGUUAGGCCGAA IUCAUUGC | 2155 |
| 2369 | AAUGACAC A GUCUUGGC | 1657 | GCCAAGAC CUGAUGAGGCCGUUAGGCCGAA IUGUCAUU | 2156 |
| 2373 | ACACAGUC U UGGCUCAC | 1658 | GUGAGCCA CUGAUGAGGCCGUUAGGCCGAA IACUGUGU | 2157 |
| 2378 | GUCUUGGC U CACUGCAA | 1659 | UUGCAGUG CUGAUGAGGCCGUUAGGCCGAA ICCAAGAC | 2158 |
| 2380 | CUUGGCUC A CUGCAACU | 1660 | AGUUGCAG CUGAUGAGGCCGUUAGGCCGAA IAGCCAAG | 2159 |
| 2382 | UGGCUCAC U GCAACUUC | 1661 | GAAGUUGC CUGAUGAGGCCGUUAGGCCGAA IUGAGCCA | 2160 |
| 2385 | CUCACUGC A ACUUCUGC | 1662 | GCAGAAGU CUGAUGAGGCCGUUAGGCCGAA ICAGUGAG | 2161 |
| 2388 | ACUGCAAC U UCUGCCUC | 1663 | GAGGCAGA CUGAUGAGGCCGUUAGGCCGAA IUUGCAGU | 2162 |
| 2391 | GCAACUUC U GCCUCUUG | 1664 | CAAGAGGC CUGAUGAGGCCGUUAGGCCGAA IAAGUUGC | 2163 |
| 2394 | ACUUCUGC C UCUUGGGU | 1665 | ACCCAAGA CUGAUGAGGCCGUUAGGCCGAA ICAGAAGU | 2164 |
| 2395 | CUUCUGCC U CUUGGGUU | 1666 | AACCCAAG CUGAUGAGGCCGUUAGGCCGAA IGCAGAAG | 2165 |
| 2397 | UCUGCCUC U UGGGUUCA | 1667 | UGAACCCA CUGAUGAGGCCGUUAGGCCGAA IAGGCAGA | 2166 |
| 2405 | UUGGGUUC A AGUGAUUC | 1668 | GAAUCACU CUGAUGAGGCCGUUAGGCCGAA IAACCCAA | 2167 |
| 2414 | AGUGAUUC U CCUGCCUC | 1669 | GAGGCAGG CUGAUGAGGCCGUUAGGCCGAA IAAUCACU | 2168 |
| 2416 | UGAUUCUC C UGCCUCAG | 1670 | CUGAGGCA CUGAUGAGGCCGUUAGGCCGAA IAGAAUCA | 2169 |
| 2417 | GAUUCUCC U GCCUCAGC | 1671 | GCUGAGGC CUGAUGAGGCCGUUAGGCCGAA IGAGAAUC | 2170 |
| 2420 | UCUCCUGC C UCAGCCUC | 1672 | GAGGCUGA CUGAUGAGGCCGUUAGGCCGAA ICAGGAGA | 2171 |
| 2421 | CUCCUGCC U CAGCCUCC | 1673 | GGAGGCUG CUGAUGAGGCCGUUAGGCCGAA IGCAGGAG | 2172 |
| 2423 | CCUGCCUC A GCCUCCUG | 1674 | CAGGAGGC CUGAUGAGGCCGUUAGGCCGAA IAGGCAGG | 2173 |
| 2426 | GCCUCAGC C UCCUGAGU | 1675 | ACUCAGGA CUGAUGAGGCCGUUAGGCCGAA ICUGAGGC | 2174 |
| 2427 | CCUCAGCC U CCUGAGUA | 1676 | UACUCAGG CUGAUGAGGCCGUUAGGCCGAA IGCUGAGG | 2175 |
| 2429 | UCAGCCUC C UGAGUAGC | 1677 | GCUACUCA CUGAUGAGGCCGUUAGGCCGAA IAGGCUGA | 2176 |
| 2430 | CAGCCUCC U GAGUAGCU | 1678 | AGCUACUC CUGAUGAGGCCGUUAGGCCGAA IGAGGCUG | 2177 |
| 2438 | UGAGUAGC U GGAUUACA | 1679 | UGUAAUCC CUGAUGAGGCCGUUAGGCCGAA ICUACUCA | 2178 |
| 2446 | UGGAUUAC A GGCAUGUG | 1680 | CACAUGCC CUGAUGAGGCCGUUAGGCCGAA IUAAUCCA | 2179 |
| 2450 | UUACAGGC A UGUGCCAC | 1681 | GUGGCACA CUGAUGAGGCCGUUAGGCCGAA ICCUGUAA | 2180 |
| 2456 | GCAUGUGC C ACCCACCC | 1682 | GGGUGGGU CUGAUGAGGCCGUUAGGCCGAA ICACAUGC | 2181 |
| 2457 | CAUGUGCC A CCCACCCA | 1683 | UGGGUGGG CUGAUGAGGCCGUUAGGCCGAA IGCACAUG | 2182 |
| 2459 | UGUGCCAC C CACCCAAC | 1684 | GUUGGGUG CUGAUGAGGCCGUUAGGCCGAA IUGGCACA | 2183 |
| 2460 | GUGCCACC C ACCCAACU | 1685 | AGUUGGGU CUGAUGAGGCCGUUAGGCCGAA IGUGGCAC | 2184 |
| 2461 | UGCCACCC A CCCAACUA | 1686 | UAGUUGGG CUGAUGAGGCCGUUAGGCCGAA IGGUGGCA | 2185 |
| 2463 | CCACCCAC C CAACUAAU | 1687 | AUUAGUUG CUGAUGAGGCCGUUAGGCCGAA IUGGGUGG | 2186 |
| 2464 | CACCCACC C AACUAAUU | 1688 | AAUUAGUU CUGAUGAGGCCGUUAGGCCGAA IGUGGGUG | 2187 |
| 2465 | ACCCACCC A ACUAAUUU | 1689 | AAAUUAGU CUGAUGAGGCCGUUAGGCCGAA IGGUGGGU | 2188 |
| 2468 | CACCCAAC U AAUUUUUG | 1690 | CAAAAAUU CUGAUGAGGCCGUUAGGCCGAA IUUGGGUG | 2189 |
| 2493 | AUAAAGAC A GGGUUUCA | 1691 | UGAAACCC CUGAUGAGGCCGUUAGGCCGAA IUCUUUAU | 2190 |
| 2501 | AGGGUUUC A CCAUGUUG | 1692 | CAACAUGG CUGAUGAGGCCGUUAGGCCGAA IAAACCCU | 2191 |
| 2503 | GGUUUCAC C AUGUUGGC | 1693 | GCCAACAU CUGAUGAGGCCGUUAGGCCGAA IUGAAACC | 2192 |
| 2504 | GUUUCACC A UGUUGGCC | 1694 | GGCCAACA CUGAUGAGGCCGUUAGGCCGAA IGUGAAAC | 2193 |
| 2512 | AUGUUGGC C AGGCUGGU | 1695 | ACCAGCCU CUGAUGAGGCCGUUAGGCCGAA ICCAACAU | 2194 |
| 2513 | UGUUGGCC A GGCUGGUC | 1696 | GACCAGCC CUGAUGAGGCCGUUAGGCCGAA IGCCAACA | 2195 |
| 2517 | GGCCAGGC U GGUCUCAA | 1697 | UUGAGACC CUGAUGAGGCCGUUAGGCCGAA ICCUGGCC | 2196 |
| 2522 | GGCUGGUC U CAAACUCC | 1698 | GGAGUUUG CUGAUGAGGCCGUUAGGCCGAA IACCAGCC | 2197 |
| 2524 | CUGGUCUC A AACUCCUG | 1699 | CAGGAGUU CUGAUGAGGCCGUUAGGCCGAA IAGACCAG | 2198 |
| 2528 | UCUCAAAC U CCUGACCU | 1700 | AGGUCAGG CUGAUGAGGCCGUUAGGCCGAA IUUUGAGA | 2199 |
| 2530 | UCAAACUC C UGACCUCA | 1701 | UGAGGUCA CUGAUGAGGCCGUUAGGCCGAA IAGUUUGA | 2200 |
| 2531 | CAAACUCC U GACCUCAA | 1702 | UUGAGGUC CUGAUGAGGCCGUUAGGCCGAA IGAGUUUG | 2201 |
| 2535 | CUCCUGAC C UCAAGUAA | 1703 | UUACUUGA CUGAUGAGGCCGUUAGGCCGAA IUCAGGAG | 2202 |
| 2536 | UCCUGACC U CAAGUAAU | 1704 | AUUACUUG CUGAUGAGGCCGUUAGGCCGAA IGUCAGGA | 2203 |
| 2538 | CUGACCUC A AGUAAUCC | 1705 | GGAUUACU CUGAUGAGGCCGUUAGGCCGAA IAGGUCAG | 2204 |
| 2546 | AAGUAAUC C ACCUGCCU | 1706 | AGGCAGGU CUGAUGAGGCCGUUAGGCCGAA IAUUACUU | 2205 |
| 2547 | AGUAAUCC A CCUGCCUC | 1707 | GAGGCAGG CUGAUGAGGCCGUUAGGCCGAA IGAUUACU | 2206 |
| 2549 | UAAUCCAC C UGCCUCGG | 1708 | CCGAGGCA CUGAUGAGGCCGUUAGGCCGAA IUGGAUUA | 2207 |
| 2550 | AAUCCACC U GCCUCGGC | 1709 | GCCGAGGC CUGAUGAGGCCGUUAGGCCGAA IGUGGAUU | 2208 |
| 2553 | CCACCUGC C UCGGCCUC | 1710 | GAGGCCGA CUGAUGAGGCCGUUAGGCCGAA ICAGGUGG | 2209 |
| 2554 | CACCUGCC U CGGCCUCC | 1711 | GGAGGCCG CUGAUGAGGCCGUUAGGCCGAA IGCAGGUG | 2210 |
| 2559 | GCCUCGGC C UCCCAAAG | 1712 | CUUUGGGA CUGAUGAGGCCGUUAGGCCGAA ICCGAGGC | 2211 |
| 2560 | CCUCGGCC U CCCAAAGU | 1713 | ACUUUGGG CUGAUGAGGCCGUUAGGCCGAA IGCCGAGG | 2212 |
| 2562 | UCGGCCUC C CAAAGUGC | 1714 | GCACUUUG CUGAUGAGGCCGUUAGGCCGAA IAGGCCGA | 2213 |
| 2563 | CGGCCUCC C AAAGUGCU | 1715 | AGCACUUU CUGAUGAGGCCGUUAGGCCGAA IGAGGCCG | 2214 |
| 2564 | GGCCUCCC A AAGUGCUG | 1716 | CAGCACUU CUGAUGAGGCCGUUAGGCCGAA IGGAGGCC | 2215 |
| 2571 | CAAAGUGC U GGGAUUAC | 1717 | GUAAUCCC CUGAUGAGGCCGUUAGGCCGAA IACUUUG | 2216 |
| 2580 | GGGAUUAC A GGGAUGAG | 1718 | CUCAUCCC CUGAUGAGGCCGUUAGGCCGAA IUAAUCCC | 2217 |
| 2590 | GGAUGAGC C ACCGCGCC | 1719 | GGCGCGGU CUGAUGAGGCCGUUAGGCCGAA ICUCAUCC | 2218 |
| 2591 | GAUGAGCC A CCGCGCCC | 1720 | GGGCGCGG CUGAUGAGGCCGUUAGGCCGAA IGCUCAUC | 2219 |

TABLE IX-continued

Human PKR Inozyme and Substrate Sequence

| Pos | Substrate | Seq ID | Inozyme | Seq ID |
|---|---|---|---|---|
| 2593 | UGAGCCAC C GCGCCCAG | 1721 | CUGGGCGC CUGAUGAGGCCGUUAGGCCGAA IUGGCUCA | 2220 |
| 2598 | CACCGCGC C CAGCCUCA | 1722 | UGAGGCUG CUGAUGAGGCCGUUAGGCCGAA ICGCGGUU | 2221 |
| 2599 | ACCGCGCC C AGCCUCAU | 1723 | AUGAGGCU CUGAUGAGGCCGUUAGGCCGAA IGCGCGGU | 2222 |
| 2600 | CCGCGCCC A GCCUCAUC | 1724 | GAUGAGGC CUGAUGAGGCCGUUAGGCCGAA IGGCGCGG | 2223 |
| 2603 | CGCCCAGC C UCAUCUCU | 1725 | AGAGAUGA CUGAUGAGGCCGUUAGGCCGAA ICUGGGCG | 2224 |
| 2604 | GCCCAGCC U CAUCUCUU | 1726 | AAGAGAUG CUGAUGAGGCCGUUAGGCCGAA IGCUGGGC | 2225 |
| 2606 | CCAGCCUC A UCUCUUUG | 1727 | CAAAGAGA CUGAUGAGGCCGUUAGGCCGAA IAGGCUGG | 2226 |
| 2609 | GCCUCAUC U CUUUGUUC | 1728 | GAACAAAG CUGAUGAGGCCGUUAGGCCGAA IAUGAGGC | 2227 |
| 2611 | CUCAUCUC U UUGUUCUA | 1729 | UAGAACAA CUGAUGAGGCCGUUAGGCCGAA IAGAUGAG | 2228 |
| 2618 | CUUUGUUC U AAAGAUGG | 1730 | CCAUCUUU CUGAUGAGGCCGUUAGGCCGAA IAACAAAG | 2229 |
| 2633 | GGAAAAAC C ACCCCAA | 1731 | UUGGGGGU CUGAUGAGGCCGUUAGGCCGAA IUUUUUCC | 2230 |
| 2634 | GAAAAACC C CCCCAAA | 1732 | UUUGGGGG CUGAUGAGGCCGUUAGGCCGAA IGUUUUUC | 2231 |
| 2636 | AAAACCAC C CCCAAAUU | 1733 | AAUUUGGG CUGAUGAGGCCGUUAGGCCGAA IUGGUUUU | 2232 |
| 2637 | AAACCACC C CCAAAUUU | 1734 | AAAUUUGG CUGAUGAGGCCGUUAGGCCGAA IGUGGUUU | 2233 |
| 2638 | AACCACCC C CAAAUUUU | 1735 | AAAAUUUG CUGAUGAGGCCGUUAGGCCGAA IGGUGGUU | 2234 |
| 2639 | ACCACCCC C AAAUUUUC | 1736 | GAAAAUUU CUGAUGAGGCCGUUAGGCCGAA IGGGUGGU | 2235 |
| 2640 | CCACCCCC A AAUUUUCU | 1737 | AGAAAAUU CUGAUGAGGCCGUUAGGCCGAA IGGGGUGG | 2236 |
| 2648 | AAAUUUUC U UUUUAUAC | 1738 | GUAUAAAA CUGAUGAGGCCGUUAGGCCGAA IAAAAUUU | 2237 |
| 2657 | UUUUAUAC U AUUAAUGA | 1739 | UCAUUAAU CUGAUGAGGCCGUUAGGCCGAA IUAUAAAA | 2238 |
| 2669 | AAUGAAUC A AUCAAUUC | 1740 | GAAUUGAU CUGAUGAGGCCGUUAGGCCGAA IAUUCAUU | 2239 |
| 2673 | AAUCAAUC A AUUCAUAU | 1741 | AUAUGAAU CUGAUGAGGCCGUUAGGCCGAA IAUUGAUU | 2240 |
| 2678 | AUCAAUUC A UAUCUAUU | 1742 | AAUAGAUA CUGAUGAGGCCGUUAGGCCGAA IAAUUGAU | 2241 |
| 2683 | UUCAUAUC U AUUUAUUA | 1743 | UAAUAAAU CUGAUGAGGCCGUUAGGCCGAA IAUAUGAA | 2242 |
| 2698 | UAAAUUUC U ACCGCUUU | 1744 | AAAGCGGU CUGAUGAGGCCGUUAGGCCGAA IAAAUUUA | 2243 |
| 2701 | AUUUCUAC C GCUUUUAG | 1745 | CUAAAAGC CUGAUGAGGCCGUUAGGCCGAA IUAGAAAU | 2244 |
| 2704 | UCUACCGC U UUUAGGCC | 1746 | GGCCUAAA CUGAUGAGGCCGUUAGGCCGAA ICGGUAGA | 2245 |
| 2712 | UUUUAGGC C AAAAAAU | 1747 | AUUUUUUU CUGAUGAGGCCGUUAGGCCGAA ICCUAAAA | 2246 |
| 2713 | UUUAGGCC A AAAAAUG | 1748 | CAUUUUUU CUGAUGAGGCCGUUAGGCCGAA IGCCUAAA | 2247 |
| 2733 | GAUCGUUC U CUGCCUCA | 1749 | UGAGGCAG CUGAUGAGGCCGUUAGGCCGAA IAACGAUC | 2248 |
| 2735 | UCGUUCUC U GCCUCACA | 1750 | UGUGAGGC CUGAUGAGGCCGUUAGGCCGAA IAGAACGA | 2249 |
| 2738 | UUCUCUGC C UCACAUAG | 1751 | CUAUGUGA CUGAUGAGGCCGUUAGGCCGAA ICAGAGAA | 2250 |
| 2739 | UCUCUGCC U CACAUAGC | 1752 | GCUAUGUG CUGAUGAGGCCGUUAGGCCGAA IGCAGAGA | 2251 |
| 2741 | UCUGCCUC A CAUAGCUU | 1753 | AAGCUAUG CUGAUGAGGCCGUUAGGCCGAA IAGGCAGA | 2252 |
| 2743 | UGCCUCAC A UAGCUUAC | 1754 | GUAAGCUA CUGAUGAGGCCGUUAGGCCGAA IUGAGGCA | 2253 |
| 2748 | CACAUAGC U UACAAGCC | 1755 | GGCUUGUA CUGAUGAGGCCGUUAGGCCGAA ICUAUGUG | 2254 |
| 2752 | UAGCUUAC A AGCCAGCU | 1756 | AGCUGGCU CUGAUGAGGCCGUUAGGCCGAA IUAAGCUA | 2255 |
| 2756 | UUACAAGC C AGCUGGAG | 1757 | CUCCAGCU CUGAUGAGGCCGUUAGGCCGAA ICUUGUAA | 2256 |
| 2757 | UACAAGCC A GCUGGAGA | 1758 | UCUCCAGC CUGAUGAGGCCGUUAGGCCGAA IGCUUGUA | 2257 |
| 2760 | AAGCCAGC U GGAGAAAU | 1759 | AUUUCUCC CUGAUGAGGCCGUUAGGCCGAA ICUGGCUU | 2258 |
| 2776 | UAUGGUAC U CAUUAAAA | 1760 | UUUUAAUG CUGAUGAGGCCGUUAGGCCGAA IUACCAUA | 2259 |
| 2778 | UGGUACUC A UUAAAAAA | 1761 | UUUUUUAA CUGAUGAGGCCGUUAGGCCGAA IAGUACCA | 2260 |

Input Sequence = NM_002759. Cut Site = CH/.
Arm Length = 8. Core Sequence = CUGAUGAG X CGAA (X = GCCGUUAGGC or other stem II)
NM_002759 (*Homo sapiens* protein kinase, interferon-inducible double stranded RNA dependent (PRKR), mRNA.; 2808 bp)

Underlined region can be any X sequence or linker, as described herein. "I" stands for Inosine.

TABLE X

Human PKR Zinzyme and Substrate Sequence

| Pos | Substrate | Seq ID | Zinzyme | Seq ID |
|---|---|---|---|---|
| 10 | CGGCGGCG G CGGCGCAG | 2261 | CUGCGCCG GCCGAAAGGCGAGUGAGGUCU CGCCGCCG | 2480 |
| 13 | CGGCGGCG G CGCAGUUU | 2433 | AAACUGCG GCCGAAAGGCGAGUGAGGUCU CGCCGCCG | 2652 |
| 15 | GCGGCGGC G CAGUUUGC | 2434 | GCAAACUG GCCGAAAGGCGAGUGAGGUCU GCCGCCGC | 2653 |
| 18 | GCGGCGCA G UUUGCUCA | 2435 | UGAGCAAA GCCGAAAGGCGAGUGAGGUCU UGCGCCGC | 2654 |
| 22 | CGCAGUUU G CUCAUACU | 2436 | AGUAUGAG GCCGAAAGGCGAGUGAGGUCU AAACUGCG | 2655 |
| 33 | CAUACUUU G UGACUUGC | 2437 | GCAAGUCA GCCGAAAGGCGAGUGAGGUCU AAAGUAUG | 2656 |
| 40 | UGUGACUU G CGGUCACA | 2438 | UGUGACCG GCCGAAAGGCGAGUGAGGUCU AAGUCACA | 2657 |
| 43 | GACUUGCG G UCACAGUG | 2439 | CACUGUGA GCCGAAAGGCGAGUGAGGUCU CGCAAGUC | 2658 |
| 49 | CGGUCACA G UGGCAUUC | 2440 | GAAUGCCA GCCGAAAGGCGAGUGAGGUCU UGUGACCG | 2659 |
| 52 | UCACAGUG G CAUUCAGC | 2441 | GCUGAAUG GCCGAAAGGCGAGUGAGGUCU CACUGUGA | 2660 |
| 59 | GGCAUUCA G CUCCACAC | 2442 | GUGUGGAG GCCGAAAGGCGAGUGAGGUCU UGAAUGCC | 2661 |
| 71 | CACACUUG G UAGAACCA | 2443 | UGGUUCUA GCCGAAAGGCGAGUGAGGUCU CAAGUGUG | 2662 |
| 83 | AACCACAG G CACGACAA | 2444 | UUGUCGUG GCCGAAAGGCGAGUGAGGUCU CUGUGGUU | 2663 |
| 92 | CACGACAA G CAUAGAAA | 2445 | UUUCUAUG GCCGAAAGGCGAGUGAGGUCU UUGUCGUG | 2664 |
| 124 | UCAUCGAG G CAUCGAGG | 2446 | CCUCGAUG GCCGAAAGGCGAGUGAGGUCU CUCGAUGA | 2665 |
| 132 | GCAUCGAG G UCCAUCCC | 2447 | GGGAUGGA GCCGAAAGGCGAGUGAGGUCU CUCGAUGC | 2666 |

TABLE X-continued

Human PKR Zinzyme and Substrate Sequence

| Pos | Substrate | | | Seq ID | Zinzyme | | | Seq ID |
|---|---|---|---|---|---|---|---|---|
| 162 | AGACCCUG | G | CUAUCAUA | 2448 | UAUGAUAG | GCCGAAAGGCGAGUGAGGUCU | CAGGGUCU | 2667 |
| 178 | AGACCUUA | G | UCUUCGCU | 2449 | AGCGAAGA | GCCGAAAGGCGAGUGAGGUCU | UAAGGUCU | 2668 |
| 184 | UAGUCUUC | G | CUGGUAUA | 2450 | UAUACCAG | GCCGAAAGGCGAGUGAGGUCU | GAAGACUA | 2669 |
| 188 | CUUCGCUG | G | UAUACUCG | 2451 | CGAGUAUA | GCCGAAAGGCGAGUGAGGUCU | CAGCGAAG | 2670 |
| 196 | GUAUACUC | G | CUGUCUGU | 2452 | ACAGACAG | GCCGAAAGGCGAGUGAGGUCU | GAGUAUAC | 2671 |
| 199 | UACUCGCU | G | UCUGUCAA | 2453 | UUGACAGA | GCCGAAAGGCGAGUGAGGUCU | AGCGAGUA | 2672 |
| 203 | CGCUGUCU | G | UCAACCAG | 2454 | CUGGUUGA | GCCGAAAGGCGAGUGAGGUCU | AGACAGCG | 2673 |
| 211 | GUCAACCA | G | CGGUUGAC | 2455 | GUCAACCG | GCCGAAAGGCGAGUGAGGUCU | UGGUUGAC | 2674 |
| 214 | AACCAGCG | G | UUGACUUU | 2456 | AAAGUCAA | GCCGAAAGGCGAGUGAGGUCU | CGCUGGUU | 2675 |
| 229 | UUUUUUAA | G | CCUUCUUU | 2457 | AAAGAAGG | GCCGAAAGGCGAGUGAGGUCU | UUAAAAAA | 2676 |
| 252 | UUUUACCA | G | UUUCUGGA | 2458 | UCCAGAAA | GCCGAAAGGCGAGUGAGGUCU | UGGUAAAA | 2677 |
| 261 | UUUCUGGA | G | CAAAUUCA | 2459 | UGAAUUUG | GCCGAAAGGCGAGUGAGGUCU | UCCAGAAA | 2678 |
| 270 | CAAAUUCA | G | UUUGCCUU | 2460 | AAGGCAAA | GCCGAAAGGCGAGUGAGGUCU | UGAAUUUG | 2679 |
| 274 | UUCAGUUU | G | CCUUCCUG | 2461 | CAGGAAGG | GCCGAAAGGCGAGUGAGGUCU | AAACUGAA | 2680 |
| 288 | CUGGAUUU | G | UAAAUUGU | 2462 | ACAAUUUA | GCCGAAAGGCGAGUGAGGUCU | AAAUCCAG | 2681 |
| 295 | UGUAAAUU | G | UAAUGACC | 2463 | GGUCAUUA | GCCGAAAGGCGAGUGAGGUCU | AAUUUACA | 2682 |
| 315 | AAACUUUA | G | CAGUUCUU | 2464 | AAGAACUG | GCCGAAAGGCGAGUGAGGUCU | UAAAGUUU | 2683 |
| 318 | CUUUAGCA | G | UUCUUCCA | 2465 | UGGAAGAA | GCCGAAAGGCGAGUGAGGUCU | UGCUAAAG | 2684 |
| 337 | UGACUCAG | G | UUUGCUUC | 2466 | GAAGCAAA | GCCGAAAGGCGAGUGAGGUCU | CUGAGUCA | 2685 |
| 341 | UCAGGUUU | G | CUUCUCUG | 2467 | CAGAGAAG | GCCGAAAGGCGAGUGAGGUCU | AAACCUGA | 2686 |
| 350 | CUUCUCUG | G | CGGUCUUC | 2468 | GAAGACCG | GCCGAAAGGCGAGUGAGGUCU | CAGAGAAG | 2687 |
| 353 | CUCUGGCG | G | UCUUCAGA | 2469 | UCUGAAGA | GCCGAAAGGCGAGUGAGGUCU | CGCCAGAG | 2688 |
| 380 | ACACUUCC | G | UGAUUAUC | 2470 | GAUAAUCA | GCCGAAAGGCGAGUGAGGUCU | GGAAGUGU | 2689 |
| 390 | GAUUAUCU | G | CGUGCAUU | 2471 | AAUGCACG | GCCGAAAGGCGAGUGAGGUCU | AGAUAAUC | 2690 |
| 392 | UUAUCUGC | G | UGCAUUUU | 2472 | AAAAUGCA | GCCGAAAGGCGAGUGAGGUCU | GCAGAUAA | 2691 |
| 394 | AUCUGCGU | G | CAUUUUGG | 2473 | CCAAAAUG | GCCGAAAGGCGAGUGAGGUCU | ACGCAGAU | 2692 |
| 408 | UGGACAAA | G | CUUCCAAC | 2474 | GUUGGAAG | GCCGAAAGGCGAGUGAGGUCU | UUUGUCCA | 2693 |
| 439 | AAGAAAUG | G | CUGGUGAU | 2475 | AUCACCAG | GCCGAAAGGCGAGUGAGGUCU | CAUUUCUU | 2694 |
| 443 | AAUGGCUG | G | UGAUCUUU | 2476 | AAAGAUCA | GCCGAAAGGCGAGUGAGGUCU | CAGCCAUU | 2695 |
| 454 | AUCUUUCA | G | CAGGUUUC | 2477 | GAAACCUG | GCCGAAAGGCGAGUGAGGUCU | UGAAAGAU | 2696 |
| 458 | UUCAGCAG | G | UUUCUUCA | 2478 | UGAAGAAA | GCCGAAAGGCGAGUGAGGUCU | CUGCUGAA | 2697 |
| 488 | UACAUACC | G | UCAGAAGC | 2479 | GCUUCUGA | GCCGAAAGGCGAGUGAGGUCU | GGUAUGUA | 2698 |
| 495 | CGUCAGAA | G | CAGGGAGU | 2262 | ACUCCCUG | GCCGAAAGGCGAGUGAGGUCU | UUCUGACG | 2481 |
| 502 | AGCAGGGA | G | UAGUACUU | 2263 | AAGUACUA | GCCGAAAGGCGAGUGAGGUCU | UCCCUGCU | 2482 |
| 505 | AGGGAGUA | G | UACUUAAA | 2264 | UUUAAGUA | GCCGAAAGGCGAGUGAGGUCU | UACUCCCU | 2483 |
| 525 | CAAGAACU | G | CCUAAUUC | 2265 | GAAUUAGG | GCCGAAAGGCGAGUGAGGUCU | AGUUCUUG | 2484 |
| 555 | GAUAGGAG | G | UUUACAUU | 2266 | AAUGUAAA | GCCGAAAGGCGAGUGAGGUCU | CUCCUAUC | 2485 |
| 568 | CAUUUCAA | G | UUUAUAUA | 2267 | UAUUAUAA | GCCGAAAGGCGAGUGAGGUCU | UUGAAAUG | 2486 |
| 599 | UCCAGAAG | G | UGAAGGUA | 2268 | UACCUUCA | GCCGAAAGGCGAGUGAGGUCU | CUUCUGGA | 2487 |
| 605 | AGGUGAAG | G | UAGAUCAA | 2269 | UUGAUCUA | GCCGAAAGGCGAGUGAGGUCU | CUUCACCU | 2488 |
| 622 | AGAAGGAA | G | CAAAAAAU | 2270 | AUUUUUUG | GCCGAAAGGCGAGUGAGGUCU | UUCCUUCU | 2489 |
| 631 | CAAAAAAU | G | CCGCAGCC | 2271 | GGCUGCGG | GCCGAAAGGCGAGUGAGGUCU | AUUUUUUG | 2490 |
| 634 | AAAAUGCC | G | CAGCCAAA | 2272 | UUUGGCUG | GCCGAAAGGCGAGUGAGGUCU | GGCAUUUU | 2491 |
| 637 | AUGCCGCA | G | CCAAAUUA | 2273 | UAAUUUGG | GCCGAAAGGCGAGUGAGGUCU | UGCGGCAU | 2492 |
| 646 | CCAAAUUA | G | CUGUUGAG | 2274 | CUCAACAG | GCCGAAAGGCGAGUGAGGUCU | UAAUUUGG | 2493 |
| 649 | AAUUAGCU | G | UUGAGAUA | 2275 | UAUCUCAA | GCCGAAAGGCGAGUGAGGUCU | AGCUAAUU | 2494 |
| 676 | AAAAGAAG | G | CAGUUAGU | 2276 | ACUAACUG | GCCGAAAGGCGAGUGAGGUCU | CUUCUUUU | 2495 |
| 679 | AGAAGGCA | G | UUAGUCCU | 2277 | AGGACUAA | GCCGAAAGGCGAGUGAGGUCU | UGCCUUCU | 2496 |
| 683 | GGCAGUUA | G | UCCUUUAU | 2278 | AUAAAGGA | GCCGAAAGGCGAGUGAGGUCU | UAACUGCC | 2497 |
| 743 | UUUACAUA | G | CCUUAUCA | 2279 | UGAUAAGG | GCCGAAAGGCGAGUGAGGUCU | CUAUGUAA | 2498 |
| 760 | AUAGAAUU | G | CCCAGAAG | 2280 | CUUCUGGG | GCCGAAAGGCGAGUGAGGUCU | AAUUCUAU | 2499 |
| 781 | GACUAACU | G | UAAAUUAU | 2281 | AUAAUUUA | GCCGAAAGGCGAGUGAGGUCU | AGUUAGUC | 2500 |
| 795 | UAUGAACA | G | UGUGCAUC | 2282 | GAUGCACA | GCCGAAAGGCGAGUGAGGUCU | UGUUCAUA | 2501 |
| 797 | UGAACAGU | G | UGCAUCGG | 2283 | CCGAUGCA | GCCGAAAGGCGAGUGAGGUCU | ACUGUUCA | 2502 |
| 799 | AACAGUGU | G | CAUCGGGG | 2284 | CCCCGAUG | GCCGAAAGGCGAGUGAGGUCU | ACACUGUU | 2503 |
| 808 | CAUCGGGG | G | UGCAUGGG | 2285 | CCCAUGCA | GCCGAAAGGCGAGUGAGGUCU | CCCCGAUG | 2504 |
| 810 | UCGGGGGU | G | CAUGGGCC | 2286 | GGCCCAUG | GCCGAAAGGCGAGUGAGGUCU | ACCCCCGA | 2505 |
| 816 | GUGCAUGG | G | CCAGAAGG | 2287 | CCUUCUGG | GCCGAAAGGCGAGUGAGGUCU | CCAUGCAC | 2506 |
| 839 | UUAUAAAU | G | CAAAAUGG | 2288 | CCAUUUUG | GCCGAAAGGCGAGUGAGGUCU | AUUUAUAA | 2507 |
| 863 | AGAAUAUA | G | UAUUGGUA | 2289 | UACCAAUA | GCCGAAAGGCGAGUGAGGUCU | UAUAUUCU | 2508 |
| 869 | UAGUAUUG | G | UACAGGUU | 2290 | AACCUGUA | GCCGAAAGGCGAGUGAGGUCU | CAAUACUA | 2509 |
| 875 | UGGUACAG | G | UUCUACUA | 2291 | UAGUAGAA | GCCGAAAGGCGAGUGAGGUCU | CUGUACCA | 2510 |
| 892 | AACAGGAA | G | CAAAACAA | 2292 | UUGUUUUG | GCCGAAAGGCGAGUGAGGUCU | UUCCUGUU | 2511 |
| 904 | AACAAUUG | G | CCGCUAAA | 2293 | UUUAGCGG | GCCGAAAGGCGAGUGAGGUCU | CAAUUGUU | 2512 |
| 907 | AAUUGGCC | G | CUAAACUU | 2294 | AAGUUUAG | GCCGAAAGGCGAGUGAGGUCU | GGCCAAUU | 2513 |
| 916 | CUAAACUU | G | CAUAUCUU | 2295 | AAGAUAUG | GCCGAAAGGCGAGUGAGGUCU | AAGUUUAG | 2514 |
| 949 | AAACCUCA | G | UGAAAUCU | 2296 | AGAUUUCA | GCCGAAAGGCGAGUGAGGUCU | UGAGGUUU | 2515 |
| 966 | GACUACCU | G | UCCUCUGG | 2297 | CCAGAGGA | GCCGAAAGGCGAGUGAGGUCU | AGGUAGUC | 2516 |
| 974 | GUCCUCUG | G | UUCUUUUG | 2298 | CAAAAGAA | GCCGAAAGGCGAGUGAGGUCU | CAGAGGAC | 2517 |
| 982 | GUUCUUUU | G | CUACUACG | 2299 | CGUAGUAG | GCCGAAAGGCGAGUGAGGUCU | AAAAGAAC | 2518 |
| 990 | GCUACUAC | G | UGUGAGUC | 2300 | GACUCACA | GCCGAAAGGCGAGUGAGGUCU | GUAGUAGC | 2519 |
| 992 | UACUACGU | G | UGAGUCCC | 2301 | GGGACUCA | GCCGAAAGGCGAGUGAGGUCU | ACGUAGUA | 2520 |
| 996 | ACGUGUGA | G | UCCCAAAG | 2302 | CUUUGGGA | GCCGAAAGGCGAGUGAGGUCU | UCACACGU | 2521 |
| 1004 | GUCCCAAA | G | CAACUCUU | 2303 | AAGAGUUG | GCCGAAAGGCGAGUGAGGUCU | UUUGGGAC | 2522 |
| 1015 | ACUCUUUA | G | UGACCAGC | 2304 | GCUGGUCA | GCCGAAAGGCGAGUGAGGUCU | UAAAGAGU | 2523 |

TABLE X-continued

Human PKR Zinzyme and Substrate Sequence

| Pos | Substrate | Seq ID | Zinzyme | Seq ID |
|---|---|---|---|---|
| 1022 | AGUGACCA G CACACUCG | 2305 | CGAGUGUG GCCGAAAGGCGAGUGAGGUCU UGGUCACU | 2524 |
| 1030 | GCACACUC G CUUCUGAA | 2306 | UUCAGAAG GCCGAAAGGCGAGUGAGGUCU GAGUGUGC | 2525 |
| 1052 | AUCUGAAG G UGACUUCU | 2307 | AGAAGUCA GCCGAAAGGCGAGUGAGGUCU CUUCAGAU | 2526 |
| 1063 | ACUUCUCA G CAGAUACA | 2308 | UGUAUCUG GCCGAAAGGCGAGUGAGGUCU UGAGAAGU | 2527 |
| 1091 | UUCUAACA G UGACAGUU | 2309 | AACUGUCA GCCGAAAGGCGAGUGAGGUCU UGUUAGAA | 2528 |
| 1097 | CAGUGACA G UUUAAACA | 2310 | UGUUUAAA GCCGAAAGGCGAGUGAGGUCU UGUCACUG | 2529 |
| 1106 | UUUAAACA G UUCUUCGU | 2311 | ACGAAGAA GCCGAAAGGCGAGUGAGGUCU UGUUUAAA | 2530 |
| 1113 | AGUUCUUC G UUGCUUAU | 2312 | AUAAGCAA GCCGAAAGGCGAGUGAGGUCU GAAGAACU | 2531 |
| 1116 | UCUUCGUU G CUUAUGAA | 2313 | UUCAUAAG GCCGAAAGGCGAGUGAGGUCU AACGAAGA | 2532 |
| 1127 | UAUGAAUG G UCUCAGAA | 2314 | UUCUGAGA GCCGAAAGGCGAGUGAGGUCU CAUUCAUA | 2533 |
| 1150 | AAAGGAAG G CAAAAGA | 2315 | UCUUUUUG GCCGAAAGGCGAGUGAGGUCU CUUCCUUU | 2534 |
| 1165 | GAUCUUUG G CACCCAGA | 2316 | UCUGGGUG GCCGAAAGGCGAGUGAGGUCU CAAAGAUC | 2535 |
| 1203 | GAAACAAA G UAUACUGU | 2317 | ACAGUAUA GCCGAAAGGCGAGUGAGGUCU UUUGUUUC | 2536 |
| 1210 | AGUAUACU G UGGACAAG | 2318 | CUUGUCCA GCCGAAAGGCGAGUGAGGUCU AGUAUACU | 2537 |
| 1221 | GACAAGAG G UUUGGCAU | 2319 | AUGCCAAA GCCGAAAGGCGAGUGAGGUCU CUCUUGUC | 2538 |
| 1226 | GAGGUUUG G CAUGGAUU | 2320 | AAUCCAUG GCCGAAAGGCGAGUGAGGUCU CAAACCUC | 2539 |
| 1256 | AUUAAUUG G CUCAGGUG | 2321 | CACCUGAG GCCGAAAGGCGAGUGAGGUCU CAAUUAAU | 2540 |
| 1262 | UGGCUCAG G UGGAUUUG | 2322 | CAAAUCCA GCCGAAAGGCGAGUGAGGUCU CUGAGCCA | 2541 |
| 1271 | UGGAUUUG G CCAAGUUU | 2323 | AAACUUGG GCCGAAAGGCGAGUGAGGUCU CAAAUCCA | 2542 |
| 1276 | UUGGCCAA G UUUUCAAA | 2324 | UUUGAAAA GCCGAAAGGCGAGUGAGGUCU UUGGCCAA | 2543 |
| 1285 | UUUUCAAA G CAAAACAC | 2325 | GUGUUUUG GCCGAAAGGCGAGUGAGGUCU UUUGAAAA | 2544 |
| 1315 | AGACUUAC G UUAUUAAA | 2326 | UUUAAUAA GCCGAAAGGCGAGUGAGGUCU GUAAGUCU | 2545 |
| 1325 | UAUUAAAC G UGUUAAAU | 2327 | AUUUAACA GCCGAAAGGCGAGUGAGGUCU GUUUAAUA | 2546 |
| 1327 | UUAAACGU G UUAAAUAU | 2328 | AUAUUUAA GCCGAAAGGCGAGUGAGGUCU ACGUUUAA | 2547 |
| 1348 | ACGAGAAG G CGGAGCGU | 2329 | ACGCUCCG GCCGAAAGGCGAGUGAGGUCU CUUCUCGU | 2548 |
| 1353 | AAGGCGGA G CGUGAAGU | 2330 | ACUUCACG GCCGAAAGGCGAGUGAGGUCU UCCGCCUU | 2549 |
| 1355 | GGCGGAGC G UGAAGUAA | 2331 | UUACUUCA GCCGAAAGGCGAGUGAGGUCU GCUCCGCC | 2550 |
| 1360 | AGCGUGAA G UAAAAGCA | 2332 | UGCUUUUA GCCGAAAGGCGAGUGAGGUCU UUCACGCU | 2551 |
| 1366 | AAGUAAAA G CAUUGGCA | 2333 | UGCCAAUG GCCGAAAGGCGAGUGAGGUCU UUUUACUU | 2552 |
| 1372 | AAGCAUUG G CAAAACUU | 2334 | AAGUUUUG GCCGAAAGGCGAGUGAGGUCU CAAUGCUU | 2553 |
| 1387 | UUGAUCAU G UAAAUAUU | 2335 | AAUAUUUA GCCGAAAGGCGAGUGAGGUCU AUGAUCAA | 2554 |
| 1396 | UAAAUAUU G UUCACUAC | 2336 | GUAGUGAA GCCGAAAGGCGAGUGAGGUCU AAUAUUUA | 2555 |
| 1409 | CUACAAUG G CUGUUGGG | 2337 | CCCAACAG GCCGAAAGGCGAGUGAGGUCU CAUUGUAG | 2556 |
| 1412 | CAAUGGCU G UUGGGAUG | 2338 | CAUCCCAA GCCGAAAGGCGAGUGAGGUCU AGCCAUUG | 2557 |
| 1445 | UGAGACCA G UGAUGAUU | 2339 | AAUCAUCA GCCGAAAGGCGAGUGAGGUCU UGGUCUCA | 2558 |
| 1463 | UCUUGAGA G CAGUGAUU | 2340 | AAUCACUG GCCGAAAGGCGAGUGAGGUCU UCUCAAGA | 2559 |
| 1466 | UGAGAGCA G UGAUUAUG | 2341 | CAUAAUCA GCCGAAAGGCGAGUGAGGUCU UGCUCUCA | 2560 |
| 1487 | UGAGAACA G CAAAAAUA | 2342 | UAUUUUUG GCCGAAAGGCGAGUGAGGUCU UGUUCUCA | 2561 |
| 1496 | CAAAAAUA G UUCAAGGU | 2343 | ACCUUGAA GCCGAAAGGCGAGUGAGGUCU UAUUUUUG | 2562 |
| 1503 | AGUUCAAG G UCAAAGAC | 2344 | GUCUUUGA GCCGAAAGGCGAGUGAGGUCU CUUGAACU | 2563 |
| 1515 | AAGACUAA G UGCCUUUU | 2345 | AAAAGGCA GCCGAAAGGCGAGUGAGGUCU UUAGUCUU | 2564 |
| 1517 | GACUAAGU G CCUUUUCA | 2346 | UGAAAAGG GCCGAAAGGCGAGUGAGGUCU ACUUAGUC | 2565 |
| 1541 | GGAAUUCU G UGAUAAAG | 2347 | CUUUAUCA GCCGAAAGGCGAGUGAGGUCU AGAAUUCC | 2566 |
| 1583 | AAGAAGAG G CGAGAAAC | 2348 | GUUUCUCG GCCGAAAGGCGAGUGAGGUCU CUCUUCUU | 2567 |
| 1600 | UAGACAAA G UUUUGGCU | 2349 | AGCCAAAA GCCGAAAGGCGAGUGAGGUCU UUUGUCUA | 2568 |
| 1606 | AAGUUUUG G CUUUGGAA | 2350 | UUCCAAAG GCCGAAAGGCGAGUGAGGUCU CAAAACUU | 2569 |
| 1639 | CAAAAGGG G UGGAUUAU | 2351 | AUAAUCCA GCCGAAAGGCGAGUGAGGUCU CCCUUUUG | 2570 |
| 1683 | GAUCUUAA G CCAAGUAA | 2352 | UUACUUGG GCCGAAAGGCGAGUGAGGUCU UUAAGAUC | 2571 |
| 1688 | UAAGCCAA G UAAUAUAU | 2353 | AUAUAUUA GCCGAAAGGCGAGUGAGGUCU UUGGCUUA | 2572 |
| 1702 | UAUUCUUA G UAGAUACA | 2354 | UGUAUCUA GCCGAAAGGCGAGUGAGGUCU UAAGAAUA | 2573 |
| 1717 | CAAAACAA G UAAAGAUU | 2355 | AAUCUUUA GCCGAAAGGCGAGUGAGGUCU UUGUUUUG | 2574 |
| 1741 | UUGGACUU G UAACAUCU | 2356 | AGAUGUUA GCCGAAAGGCGAGUGAGGUCU AAGUCCAA | 2575 |
| 1767 | GAUGGAAA G CGAACAAG | 2357 | CUUGUUCG GCCGAAAGGCGAGUGAGGUCU UUUCCAUC | 2576 |
| 1778 | AACAAGGA G UAAGGGAA | 2358 | UUCCCUUA GCCGAAAGGCGAGUGAGGUCU UCCUUGUU | 2577 |
| 1791 | GGAACUUU G CGAUACAU | 2359 | AUGUAUCG GCCGAAAGGCGAGUGAGGUCU AAAGUUCC | 2578 |
| 1802 | AUACAUGA G CCCAGAAC | 2360 | GUUCUGGG GCCGAAAGGCGAGUGAGGUCU UCAUGUAU | 2579 |
| 1821 | AUUUCUUC G CAAGACUA | 2361 | UAGUCUUG GCCGAAAGGCGAGUGAGGUCU GAAGAAAU | 2580 |
| 1840 | GAAAGGAA G UGGACCUC | 2362 | GAGGUCCA GCCGAAAGGCGAGUGAGGUCU UUCCUUUC | 2581 |
| 1852 | ACCUCUAC G CUUUGGGG | 2363 | CCCCAAAG GCCGAAAGGCGAGUGAGGUCU GUAGAGGU | 2582 |
| 1860 | GCUUUGGG G CUAAUUCU | 2364 | AGAAUUAG GCCGAAAGGCGAGUGAGGUCU CCCAAAGC | 2583 |
| 1870 | UAAUUCUU G CUGAACUU | 2365 | AAGUUCAG GCCGAAAGGCGAGUGAGGUCU AAGAAUUA | 2584 |
| 1885 | UUCUUCAU G UAUGUGAC | 2366 | GUCACAUA GCCGAAAGGCGAGUGAGGUCU AUGAAGAA | 2585 |
| 1889 | UCAUGUAU G UGACACUG | 2367 | CAGUGUCA GCCGAAAGGCGAGUGAGGUCU AUACAUGA | 2586 |
| 1897 | GUGACACU G CUUUUGAA | 2368 | UUCAAAAG GCCGAAAGGCGAGUGAGGUCU AGUGUCAC | 2587 |
| 1914 | ACAUCAAA G UUUUUCAC | 2369 | GUGAAAAA GCCGAAAGGCGAGUGAGGUCU UUUGAUGU | 2588 |
| 1937 | ACGGGAUG G CAUCAUCU | 2370 | AGAUGAUG GCCGAAAGGCGAGUGAGGUCU CAUCCCGU | 2589 |
| 2047 | CCUUGACU G UGUGGAAG | 2371 | CUUCCACA GCCGAAAGGCGAGUGAGGUCU AGUCAAGG | 2590 |
| 2049 | UUGACUGU G UGGAAGAA | 2372 | UUCUUCCA GCCGAAAGGCGAGUGAGGUCU ACAGUCAA | 2591 |
| 2060 | GAAGAAAA G CCCAGAGA | 2373 | UCUCUGGG GCCGAAAGGCGAGUGAGGUCU UUUCUUC | 2592 |
| 2087 | ACACACAU G UUAGAGCC | 2374 | GGCUCUAA GCCGAAAGGCGAGUGAGGUCU AUGUGUGU | 2593 |
| 2093 | AUGUUAGA G CCCUUCUG | 2375 | CAGAAGGG GCCGAAAGGCGAGUGAGGUCU UCUAACAU | 2594 |
| 2107 | CUGAAAAA G UAUCCUGC | 2376 | GCAGGAUA GCCGAAAGGCGAGUGAGGUCU UUUUUCAG | 2595 |
| 2114 | AGUAUCCU G CUUCUGAU | 2377 | AUCAGAAG GCCGAAAGGCGAGUGAGGUCU AGGAUACU | 2596 |
| 2125 | UCUGAUAU G CAGUUUUC | 2378 | GAAAACUG GCCGAAAGGCGAGUGAGGUCU AUAUCAGA | 2597 |
| 2128 | GAUAUGCA G UUUUCCUU | 2379 | AAGGAAAA GCCGAAAGGCGAGUGAGGUCU UGCAUAUC | 2598 |

TABLE X-continued

Human PKR Zinzyme and Substrate Sequence

| Pos | Substrate | Seq ID | Zinzyme | Seq ID |
|---|---|---|---|---|
| 2153 | UAAAAUCU G CUAGGGAA | 2380 | UUCCCUAG GCCGAAAGGCGAGUGAGGUCU AGAUUUUA | 2599 |
| 2192 | AUUUUAAU G UUUCCUUU | 2381 | AAAGGAAA GCCGAAAGGCGAGUGAGGUCU AUUAAAAU | 2600 |
| 2230 | AUCUUUCU G CAGAAACA | 2382 | UGUUUCUG GCCGAAAGGCGAGUGAGGUCU AGAAAGAU | 2601 |
| 2244 | ACAGAAAG G UUUUCUUC | 2383 | GAAGAAAA GCCGAAAGGCGAGUGAGGUCU CUUUCUGU | 2602 |
| 2258 | UUCUUUUU G CUUCAAAA | 2384 | UUUUGAAG GCCGAAAGGCGAGUGAGGUCU AAAAAGAA | 2603 |
| 2293 | UUUUCCUG G CUCAUCUC | 2385 | GAGAUGAG GCCGAAAGGCGAGUGAGGUCU CAGGAAAA | 2604 |
| 2332 | AAGACAGA G UCUCGCUC | 2386 | GAGCGAGA GCCGAAAGGCGAGUGAGGUCU UCUGUCUU | 2605 |
| 2337 | AGAGUCUC G CUCUGUUG | 2387 | CAACAGAG GCCGAAAGGCGAGUGAGGUCU GAGACUCU | 2606 |
| 2342 | CUCGCUCU G UUGCCAAG | 2388 | CUGGGCAA GCCGAAAGGCGAGUGAGGUCU AGAGCGAG | 2607 |
| 2345 | GCUCUGUU G CCCAGGCU | 2389 | AGCCUGGG GCCGAAAGGCGAGUGAGGUCU AACAGAGC | 2608 |
| 2351 | UUGCCCAG G CUGGAGUG | 2390 | CACUCCAG GCCGAAAGGCGAGUGAGGUCU CUGGGCAA | 2609 |
| 2357 | AGGCUGGA G UGCAAUGA | 2391 | UCAUUGCA GCCGAAAGGCGAGUGAGGUCU UCCAGCCU | 2610 |
| 2359 | GCUGGAGU G CAAUGACA | 2392 | UGUCAUUG GCCGAAAGGCGAGUGAGGUCU ACUCCAGC | 2611 |
| 2370 | AUGACACA G UCUUGGCU | 2393 | AGCCAAGA GCCGAAAGGCGAGUGAGGUCU UGUGUCAU | 2612 |
| 2376 | CAGUCUUG G CUCACUGC | 2394 | GCAGUGAG GCCGAAAGGCGAGUGAGGUCU CAAGACUG | 2613 |
| 2383 | GGCUCACU G CAACUUCU | 2395 | AGAAGUUG GCCGAAAGGCGAGUGAGGUCU AGUGAGCC | 2614 |
| 2392 | CAACUUCU G CCUCUUGG | 2396 | CCAAGAGG GCCGAAAGGCGAGUGAGGUCU AGAAGUUG | 2615 |
| 2401 | CCUCUUGG G UUCAAGUG | 2397 | CACUUGAA GCCGAAAGGCGAGUGAGGUCU CCAAGAGG | 2616 |
| 2407 | GGGUUCAA G UGAUUCUC | 2398 | GAGAAUCA GCCGAAAGGCGAGUGAGGUCU UUGAACCC | 2617 |
| 2418 | AUUCUCCU G CCUCAGCC | 2399 | GGCUGAGG GCCGAAAGGCGAGUGAGGUCU AGGAGAAU | 2618 |
| 2424 | CUGCCUCA G CCUCCUGA | 2400 | UCAGGAGG GCCGAAAGGCGAGUGAGGUCU UGAGGCAG | 2619 |
| 2433 | CCUCCUGA G UAGCUGGA | 2401 | UCCAGCUA GCCGAAAGGCGAGUGAGGUCU UCAGGAGG | 2620 |
| 2436 | CCUGAGUA G CUGGAUUA | 2402 | UAAUCCAG GCCGAAAGGCGAGUGAGGUCU UACUCAGG | 2621 |
| 2448 | GAUUACAG G CAUGUGCC | 2403 | GGCACAUG GCCGAAAGGCGAGUGAGGUCU CUGUAAUC | 2622 |
| 2452 | ACAGGCAU G UGCCACCC | 2404 | GGGUGGCA GCCGAAAGGCGAGUGAGGUCU AUGCCUGU | 2623 |
| 2454 | AGGCAUGU G CCACCCAC | 2405 | GUGGGUGG GCCGAAAGGCGAGUGAGGUCU ACAUGCCU | 2624 |
| 2476 | UAAUUUUU G UGUUUUUA | 2406 | UAAAAACA GCCGAAAGGCGAGUGAGGUCU AAAAAUUA | 2625 |
| 2478 | AUUUUUGU G UUUUUAAU | 2407 | AUUAAAAA GCCGAAAGGCGAGUGAGGUCU ACAAAAAU | 2626 |
| 2496 | AAGACAGG G UUUACCA | 2408 | UGGUGAAA GCCGAAAGGCGAGUGAGGUCU CCUGUCUU | 2627 |
| 2506 | UUCACCAU G UUGGCCAA | 2409 | CUGGCCAA GCCGAAAGGCGAGUGAGGUCU AUGGUGAA | 2628 |
| 2510 | CCAUGUUG G CCAGGCUG | 2410 | CAGCCUGG GCCGAAAGGCGAGUGAGGUCU CAACAUGG | 2629 |
| 2515 | UUGGCCAG G CUGGUCUC | 2411 | GAGACCAG GCCGAAAGGCGAGUGAGGUCU CUGGCCAA | 2630 |
| 2519 | CCAGGCUG G UCUCAAAC | 2412 | GUUUGAGA GCCGAAAGGCGAGUGAGGUCU CAGCCUGG | 2631 |
| 2540 | GACCUCAA G UAAUCCAC | 2413 | GUGGAUUA GCCGAAAGGCGAGUGAGGUCU UUGAGGUC | 2632 |
| 2551 | AUCCACCU G CCUCGGCC | 2414 | GGCCGAGG GCCGAAAGGCGAGUGAGGUCU AGGUGGAU | 2633 |
| 2557 | CUGCCUCG G CCUCCCAA | 2415 | UUGGGAGG GCCGAAAGGCGAGUGAGGUCU CGAGGCAG | 2634 |
| 2567 | CUCCCAAA G UGCUGGGA | 2416 | UCCCAGCA GCCGAAAGGCGAGUGAGGUCU UUUGGGAG | 2635 |
| 2569 | CCCAAAGU G CUGGGAUU | 2417 | AAUCCCAG GCCGAAAGGCGAGUGAGGUCU ACUUUGGG | 2636 |
| 2588 | AGGGAUGA G CCACCGCG | 2418 | CGCGCUGG GCCGAAAGGCGAGUGAGGUCU UCAUCCCU | 2637 |
| 2594 | GAGCCACC G CGCCCAGC | 2419 | GCUGGGCG GCCGAAAGGCGAGUGAGGUCU GGUGGCUC | 2638 |
| 2596 | GCCACCGC G CCCAGCCU | 2420 | AGGCUGGG GCCGAAAGGCGAGUGAGGUCU GCGGUGGC | 2639 |
| 2601 | CGCGCCCA G CCUCAUCU | 2421 | AGAUGAGG GCCGAAAGGCGAGUGAGGUCU UGGGCGCG | 2640 |
| 2614 | AUCUCUUU G UUCUAAAG | 2422 | CUUUAGAA GCCGAAAGGCGAGUGAGGUCU AAAGAGAU | 2641 |
| 2702 | UUUCUACC G CUUUUAGG | 2423 | CCUAAAAG GCCGAAAGGCGAGUGAGGUCU GGUAGAAA | 2642 |
| 2710 | GCUUUUAG G CCAAAAAA | 2424 | UUUUUUGG GCCGAAAGGCGAGUGAGGUCU CUAAAAGC | 2643 |
| 2721 | AAAAAAAU G UAAGAUCG | 2425 | CGAUCUUA GCCGAAAGGCGAGUGAGGUCU AUUUUUUU | 2644 |
| 2729 | GUAAGAUC G UUCUCUGC | 2426 | GCAGAGAA GCCGAAAGGCGAGUGAGGUCU GAUCUUAC | 2645 |
| 2736 | CGUUCUCU G CCUCACAU | 2427 | AUGUGAGG GCCGAAAGGCGAGUGAGGUCU AGAGAACG | 2646 |
| 2746 | CUCACAUA G CUUACAAG | 2428 | CUUGUAAG GCCGAAAGGCGAGUGAGGUCU UAUGUGAG | 2647 |
| 2754 | GCUUACAA G CCAGCUGG | 2429 | CCAGCUGG GCCGAAAGGCGAGUGAGGUCU UUGUAAGC | 2648 |
| 2758 | ACAAGCCA G CUGGAGAA | 2430 | UUCUCCAG GCCGAAAGGCGAGUGAGGUCU UGGCUUGU | 2649 |
| 2772 | GAAAUAUG G UACUCAUU | 2431 | AAUGAGUA GCCGAAAGGCGAGUGAGGUCU CAUAUUUC | 2650 |
| 2796 | AAAAAAAA G UGAUGUAC | 2432 | GUACAUCA GCCGAAAGGCGAGUGAGGUCU UUUUUUUU | 2651 |

Input Sequence = NM_002759. Cut Site = G/Y
Arm Length = 8. Core Sequence = GCcgaaagGCGaGuCaaGGuCu NM_002759 (*Homo sapiens* protein kinase, interferon-inducible double stranded RNA dependent (PRKR), mRNA.; 2808 bp)

TABLE XI

Human PKR DNAzyme and Substrate Sequence

| Pos | Substrate | Seq ID | DNAzyme | Seq ID |
|---|---|---|---|---|
| 10 | CGGCGGCG G CGGCGCAG | 2261 | CTGCGCCG GGCTAGCTACAACGA CGCCGCCG | 2904 |
| 13 | CGGCGGCG G CGCAGUUU | 2433 | AAACTGCG GGCTAGCTACAACGA CGCCGCCG | 2905 |
| 15 | GCGGCGGC G CAGUUUGC | 2434 | GCAAACTG GGCTAGCTACAACGA GCCGCCGC | 2906 |
| 18 | GCGGCGCA G UUUGCUCA | 2435 | TGAGCAAA GGCTAGCTACAACGA TGCGCCGC | 2907 |
| 22 | CGCAGUUU G CUCAUACU | 2436 | AGTATGAG GGCTAGCTACAACGA AAACTGCG | 2908 |
| 26 | GUUUGCUC A UACUUUGU | 1265 | ACAAAGTA GGCTAGCTACAACGA GAGCAAAC | 2909 |
| 28 | UUGCUCAU A CUUUGUGA | 4 | TCACAAAG GGCTAGCTACAACGA ATGAGCAA | 2910 |
| 33 | CAUACUUU G UGACUUGC | 2437 | GCAAGTCA GGCTAGCTACAACGA AAAGTATG | 2911 |

TABLE XI-continued

Human PKR DNAzyme and Substrate Sequence

| Pos | Substrate | Seq ID | DNAzyme | Seq ID |
|---|---|---|---|---|
| 36 | ACUUUGUG A CUUGCGGU | 2699 | ACCGCAAG GGCTAGCTACAACGA CACAAAGT | 2912 |
| 40 | UGUGACUU G CGGUCACA | 2438 | TGTGACCG GGCTAGCTACAACGA AAGTCACA | 2913 |
| 43 | GACUUGCG G UCACAGUG | 2439 | CACTGTGA GGCTAGCTACAACGA CGCAAGTC | 2914 |
| 46 | UUGCGGUC A CAGUGGCA | 1268 | TGCCACTG GGCTAGCTACAACGA GACCGCAA | 2915 |
| 49 | CGGUCACA G UGGCAUUC | 2440 | GAATGCCA GGCTAGCTACAACGA TGTGACCG | 2916 |
| 52 | UCACAGUG G CAUUCAGC | 2441 | GCTGAATG GGCTAGCTACAACGA CACTGTGA | 2917 |
| 54 | ACAGUGGC A UUCAGCUC | 1270 | GAGCTGAA GGCTAGCTACAACGA GCCACTGT | 2918 |
| 59 | GGCAUUCA G CUCCACAC | 2442 | GTGTGGAG GGCTAGCTACAACGA TGAATGCC | 2919 |
| 64 | UCAGCUCC A CACUUGGU | 1274 | ACCAAGTG GGCTAGCTACAACGA GGAGCTGA | 2920 |
| 66 | AGCUCCAC A CUUGGUAG | 1275 | CTACCAAG GGCTAGCTACAACGA GTGGAGCT | 2921 |
| 71 | CACACUUG G UAGAACCA | 2443 | TGGTTCTA GGCTAGCTACAACGA CAAGTGTG | 2922 |
| 76 | UUGGUAGA A CCACAGGC | 2700 | GCCTGTGG GGCTAGCTACAACGA TCTACCAA | 2923 |
| 79 | GUAGAACC A CAGGCACG | 1278 | GCTGCCTG GGCTAGCTACAACGA GGTTCTAC | 2924 |
| 83 | AACCACAG G CACGACAA | 2444 | TTGTCGTG GGCTAGCTACAACGA CTGTGGTT | 2925 |
| 85 | CCACAGGC A CGACAAGC | 1280 | GCTTGTCG GGCTAGCTACAACGA GCCTGTGG | 2926 |
| 88 | CAGGCACG A CAAGCAUA | 2701 | TATGCTTG GGCTAGCTACAACGA CGTGCCTG | 2927 |
| 92 | CACGACAA G CAUAGAAA | 2445 | TTTCTATG GGCTAGCTACAACGA TTGTCGTG | 2928 |
| 94 | CGACAAGC A UAGAAACA | 1282 | TGTTTCTA GGCTAGCTACAACGA GCTTGTCG | 2929 |
| 100 | GCAUAGAA A CAUCCUAA | 2702 | TTAGGATG GGCTAGCTACAACGA TTCTATGC | 2930 |
| 102 | AUAGAAAC A UCCUAAAC | 1283 | GTTTAGGA GGCTAGCTACAACGA GTTTCTAT | 2931 |
| 109 | CAUCCUAA C CAAUCUUC | 2703 | GAAGATTG GGCTAGCTACAACGA TTAGGATG | 2932 |
| 112 | CCUAAACA A UCUUCAUC | 2704 | GATGAAGA GGCTAGCTACAACGA TGTTTAGG | 2933 |
| 118 | CAAUCUUC A UCGAGGCA | 1288 | TGCCTCGA GGCTAGCTACAACGA GAAGATTG | 2934 |
| 124 | UCAUCGAG G CAUCGAGG | 2446 | CCTCGATG GGCTAGCTACAACGA CTCGATGA | 2935 |
| 126 | AUCGAGGC A UCGAGGCC | 1289 | GACCTCGA GGCTAGCTACAACGA GCCTCGAT | 2936 |
| 132 | GCAUCGAG G UCCAUCCC | 2447 | GGGATGGA GGCTAGCTACAACGA CTCGATGC | 2937 |
| 136 | CGAGGUCC A UCCCAAUA | 1291 | TATTGGGA GGCTAGCTACAACGA GGACCTCG | 2938 |
| 142 | CCAUCCCA A UAAAAAUC | 2705 | GATTTTTA GGCTAGCTACAACGA TGGGATGG | 2939 |
| 148 | CAAUAAAA A UCAGGAGA | 2706 | TCTCCTGA GGCTAGCTACAACGA TTTTATTG | 2940 |
| 156 | AUCAGGAG A CCCUGGCU | 2707 | AGCCAGGG GGCTAGCTACAACGA CTCCTGAT | 2941 |
| 162 | AGACCCUG G CUAUCAUA | 2448 | TATGATAG GGCTAGCTACAACGA CAGGGTCT | 2942 |
| 165 | CCCUGGCU A UCAUAGAC | 26 | GTCTATGA GGCTAGCTACAACGA AGCCAGGG | 2943 |
| 168 | UGGCUAUC A UAGACCUU | 1300 | AAGGTCTA GGCTAGCTACAACGA GATAGCCA | 2944 |
| 172 | UAUCAUAG A CCUUAGUC | 2708 | GACTAAGG GGCTAGCTACAACGA CTATGATA | 2945 |
| 178 | AGACCUUA G UCUUCGCU | 2449 | AGCGAAGA GGCTAGCTACAACGA TAAGGTCT | 2946 |
| 184 | UAGUCUUC G CUGGUAUA | 2450 | TATACCAG GGCTAGCTACAACGA GAAGACTA | 2947 |
| 188 | CUUCGCUG G UAUACUCG | 2451 | CGAGTATA GGCTAGCTACAACGA CAGCGAAG | 2948 |
| 190 | UCGCUGGU A UACUCGCU | 34 | AGCGAGTA GGCTAGCTACAACGA ACCAGCGA | 2949 |
| 192 | GCUGGUAU A CUCGCUGU | 35 | ACAGCGAG GGCTAGCTACAACGA ATACCAGC | 2950 |
| 196 | GUAUACUC G CUGUCUGU | 2452 | ACAGACAG GGCTAGCTACAACGA GAGTATAC | 2951 |
| 199 | UACUCGCU G UCAACCAG | 2453 | TTGACAGA GGCTAGCTACAACGA AGCGAGTA | 2952 |
| 203 | CGCUGUCU G UCAACCAG | 2454 | CTGGTTGA GGCTAGCTACAACGA AGACAGCG | 2953 |
| 207 | GUCUGUCA A CCAGCGGU | 2709 | ACCGCTGG GGCTAGCTACAACGA TGACAGAC | 2954 |
| 211 | GUCAACCA G CGGUUGAC | 2455 | GTCAACCG GGCTAGCTACAACGA TGGTTGAC | 2955 |
| 214 | AACCAGCG G UUGACUUU | 2456 | AAAGTCAA GGCTAGCTACAACGA CGCTGGTT | 2956 |
| 218 | AGCGGUUG A CUUUUUUU | 2710 | AAAAAAAG GGCTAGCTACAACGA CAACCGCT | 2957 |
| 229 | UUUUUUAA G CCUUCUUU | 2457 | AAAGAAGG GGCTAGCTACAACGA TTAAAAAA | 2958 |
| 248 | UCUCUUUU A CCAGUUUC | 59 | GAAACTGG GGCTAGCTACAACGA AAAAGAGA | 2959 |
| 252 | UUUUACCA G UUUCUGGA | 2458 | TCCAGAAA GGCTAGCTACAACGA TGGTAAAA | 2960 |
| 261 | UUUCUGGA G CAAAUUCA | 2459 | TGAATTTG GGCTAGCTACAACGA TCCAGAAA | 2961 |
| 265 | UGGAGCAA A UUCAGUUU | 2711 | AAACTGAA GGCTAGCTACAACGA TTGCTCCA | 2962 |
| 270 | CAAAUUCA G UUUGCCUU | 2460 | AAGGCAAA GGCTAGCTACAACGA TGAATTTG | 2963 |
| 274 | UUCAGUUU G CCUUCCUG | 2461 | CAGGAAGG GGCTAGCTACAACGA AAACTGAA | 2964 |
| 284 | CUUCCUGG A UUUGUAAA | 2712 | TTTACAAA GGCTAGCTACAACGA CCAGGAAG | 2965 |
| 288 | CUGGAUUU G UAAAUUGU | 2462 | ACAATTTA GGCTAGCTACAACGA AAATCCAG | 2966 |
| 292 | AUUUGUAA A UUGUAAUG | 2713 | CATTACAA GGCTAGCTACAACGA TTACAAAT | 2967 |
| 295 | UGUAAAUU G UAAUGACC | 2463 | GGTCATTA GGCTAGCTACAACGA AATTTACA | 2968 |
| 298 | AAAUUGUA A UGACCUCA | 2714 | TGAGGTCA GGCTAGCTACAACGA TACAATTT | 2969 |
| 301 | UUGUAAUG A CCUCAAAA | 2715 | TTTTGAGG GGCTAGCTACAACGA CATTACAA | 2970 |
| 309 | ACCUCAAA A CUUUAGCA | 2716 | TGCTAAAG GGCTAGCTACAACGA TTTGAGGT | 2971 |
| 315 | AAACUUUA G CAGUUCUU | 2464 | AAGAACTG GGCTAGCTACAACGA TAAAGTTT | 2972 |
| 318 | CUUUAGCA G UUCUUCCA | 2465 | TGGAAGAA GGCTAGCTACAACGA TGCTAAAG | 2973 |
| 326 | GUUCUUCC A UCUGACUC | 1333 | GAGTCAGA GGCTAGCTACAACGA GGAAGAAC | 2974 |
| 331 | UCCAUCUG A CUCAGGUU | 2717 | AACCTGAG GGCTAGCTACAACGA CAGATGGA | 2975 |
| 337 | UGACUCAG G UUUGCUUC | 2466 | GAAGCAAA GGCTAGCTACAACGA CTGAGTCA | 2976 |
| 341 | UCAGGUUU G CUUCUCUG | 2467 | CAGAGAAG GGCTAGCTACAACGA AAACCTGA | 2977 |
| 350 | CUUCUCUG G CGGUCUUC | 2468 | GAAGACCG GGCTAGCTACAACGA CAGAGAAG | 2978 |
| 353 | CUCUGGCG G UCUUCAGA | 2469 | TCTGAAGA GGCTAGCTACAACGA CGCCAGAG | 2979 |
| 362 | UCUUCAGA A UCAACAUC | 2718 | GATGTTGA GGCTAGCTACAACGA TCTGAAGA | 2980 |
| 366 | CAGAAUCA A CAUCCACA | 2719 | TGTGGATG GGCTAGCTACAACGA TGATTCTG | 2981 |
| 368 | GAAUCAAC A UCCACACU | 1343 | AGTGTGGA GGCTAGCTACAACGA GTTGATTC | 2982 |
| 372 | CAACAUCC A CACUUCCG | 1345 | CGGAAGTG GGCTAGCTACAACGA GGATGTTG | 2983 |
| 374 | ACAUCCAC A CUUCCGUG | 1346 | CACGGAAG GGCTAGCTACAACGA GTGGATGT | 2984 |
| 380 | ACACUUCC G UGAUUAUC | 2470 | GATAATCA GGCTAGCTACAACGA GGAAGTGT | 2985 |
| 383 | CUUCCGUG A UUAUCUGC | 2720 | GCAGATAA GGCTAGCTACAACGA CACGGAAG | 2986 |

TABLE XI-continued

Human PKR DNAzyme and Substrate Sequence

| Pos | Substrate | Seq ID | DNAzyme | Seq ID |
|---|---|---|---|---|
| 386 | CCGUGAUU A UCUGCGUG | 97 | CACGCAGA GGCTAGCTACAACGA AATCACGG | 2987 |
| 390 | GAUUAUCU G CGUGCAUU | 2471 | AATGCACG GGCTAGCTACAACGA AGATAATC | 2988 |
| 392 | UUAUCGCG G UGCAUUUU | 2472 | AAAATGCA GGCTAGCTACAACGA GCAGATAA | 2989 |
| 394 | AUCUGCGU G CAUUUUGG | 2473 | CCAAAATG GGCTAGCTACAACGA ACGCAGAT | 2990 |
| 396 | CUGCGUGC A UUUUGGAC | 1350 | GTCCAAAA GGCTAGCTACAACGA GCACGCAG | 2991 |
| 403 | CAUUUUGG A CAAAGCUU | 2721 | AAGCTTTG GGCTAGCTACAACGA CCAAAATG | 2992 |
| 408 | UGGACAAA G CUUCCAAC | 2474 | GTTGGAAG GGCTAGCTACAACGA TTTGTCCA | 2993 |
| 415 | AGCUUCCA A CCAGGAUA | 2722 | TATCCTGG GGCTAGCTACAACGA TGGAAGCT | 2994 |
| 421 | CAACCAGG A UACGGGAA | 2723 | TTCCCGTA GGCTAGCTACAACGA CCTGGTTG | 2995 |
| 423 | ACCAGGAU A CGGGAAGA | 104 | TCTTCCCG GGCTAGCTACAACGA ATCCTGGT | 2996 |
| 436 | AAGAAGAA A UGGCUGGU | 2724 | ACCAGCCA GGCTAGCTACAACGA TTCTTCTT | 2997 |
| 439 | AAGAAAUG G CUGGUGAU | 2475 | ATCACCAG GGCTAGCTACAACGA CATTTCTT | 2998 |
| 443 | AAUGGCUG G UGAUCUUU | 2476 | AAAGATCA GGCTAGCTACAACGA CAGCCATT | 2999 |
| 446 | GGCUGGUG A UCUUUCAG | 2725 | CTGAAAGA GGCTAGCTACAACGA CACCAGCC | 3000 |
| 454 | AUCUUUCA G CAGGUUUC | 2477 | GAAACCTG GGCTAGCTACAACGA TGAAAGAT | 3001 |
| 458 | UUCAGCAG G UUUCUUCA | 2478 | TGAAGAAA GGCTAGCTACAACGA CTGCTGAA | 3002 |
| 466 | GUUUCUUC A UGGAGGAA | 1362 | TTCCTCCA GGCTAGCTACAACGA GAAGAAAC | 3003 |
| 474 | AUGGAGGA A CUUAAUAC | 2726 | GTATTAAG GGCTAGCTACAACGA TCCTCCAT | 3004 |
| 479 | GGAACUUA A UACAUACC | 2727 | GGTATGTA GGCTAGCTACAACGA TAAGTTCC | 3005 |
| 481 | AACUUAAU A CAUACCGU | 116 | ACGGTATG GGCTAGCTACAACGA ATTAAGTT | 3006 |
| 483 | CUUAAUAC A UACCGUCA | 1364 | TGACGGTA GGCTAGCTACAACGA GTATTAAG | 3007 |
| 485 | UAAUACAU A CCGUCAGA | 117 | TCTGACGG GGCTAGCTACAACGA ATGTATTA | 3008 |
| 488 | UACAUACC G UCAGAAGC | 2479 | GCTTCTGA GGCTAGCTACAACGA GGTATGTA | 3009 |
| 495 | CGUCAGAA G CAGGGAGU | 2262 | ACTCCCTG GGCTAGCTACAACGA TTCTGACG | 3010 |
| 502 | AGCAGGGA G UAGACUUU | 2263 | AAGTACTA GGCTAGCTACAACGA TCCCTGCT | 3011 |
| 505 | AGGGAGUA G UACUUAAA | 2264 | TTTAAGTA GGCTAGCTACAACGA TACTCCCT | 3012 |
| 507 | GGAGUAGU A CUUAAAUA | 120 | TATTTAAG GGCTAGCTACAACGA ACTACTCC | 3013 |
| 513 | GUACUUAA A UAUCAAGA | 2728 | TCTTGATA GGCTAGCTACAACGA TTAAGTAC | 3014 |
| 515 | ACUUAAAU A UCAAGAAC | 123 | GTTCTTGA GGCTAGCTACAACGA ATTTAAGT | 3015 |
| 522 | UAUCAAGA A CUGCCUAA | 2729 | TTAGGCAG GGCTAGCTACAACGA TCTTGATA | 3016 |
| 525 | CAAGAACU G CCUAAUUC | 2265 | GAATTAGG GGCTAGCTACAACGA AGTTCTTG | 3017 |
| 530 | ACUGCCUA A UUCAGGAC | 2730 | GTCCTGAA GGCTAGCTACAACGA TAGGCAGT | 3018 |
| 537 | AAUUCAGG A CCUCCACA | 2731 | TGTGGAGG GGCTAGCTACAACGA CCTGAATT | 3019 |
| 543 | GGACCUCC A CAUGAUAG | 1377 | CTATCATG GGCTAGCTACAACGA GGAGGTCC | 3020 |
| 545 | ACCUCCAC A UGAUAGGA | 1378 | TCCTATCA GGCTAGCTACAACGA GTGGAGGT | 3021 |
| 548 | UCCACAUG A UAGGAGGU | 2732 | ACCTCCTA GGCTAGCTACAACGA CATGTGGA | 3022 |
| 555 | GAUAGGAG G UUUACAUU | 2266 | AATGTAAA GGCTAGCTACAACGA CTCCTATC | 3023 |
| 559 | GGAGGUUU A CAUUUCAA | 132 | TTGAAATG GGCTAGCTACAACGA AAACCTCC | 3024 |
| 561 | AGGUUUAC A UUUCAAGU | 1379 | ACTTGAAA GGCTAGCTACAACGA GTAAACCT | 3025 |
| 568 | CAUUUCAA G UUAUAAUA | 2267 | TATTATAA GGCTAGCTACAACGA TTGAAATG | 3026 |
| 571 | UUCAAGUU A UAAUAGAU | 137 | ATCTATTA GGCTAGCTACAACGA AACTTGAA | 3027 |
| 574 | AAGUUAUA A UAGAUGGA | 2733 | TCCATCTA GGCTAGCTACAACGA TATAACTT | 3028 |
| 578 | UAUAAUAG A UGGAAGAG | 2734 | CTCTTCCA GGCTAGCTACAACGA CTATTATA | 3029 |
| 588 | GGAAGAGA A UUCCAGAA | 2735 | TCTGGAAA GGCTAGCTACAACGA TCTCTTCC | 3030 |
| 599 | UCCAGAAG G UGAAGGUA | 2268 | TACCTTCA GGCTAGCTACAACGA CTTCTGGA | 3031 |
| 605 | AGGUGAAG G UAGAUCAA | 2269 | TTGATCTA GGCTAGCTACAACGA CTTCACCT | 3032 |
| 609 | GAAGGUAG A UCAAAGAA | 2736 | TTCTTTGA GGCTAGCTACAACGA CTACCTTC | 3033 |
| 622 | AGAAGGAA G CAAAAAAU | 2270 | ATTTTTTG GGCTAGCTACAACGA TTCCTTCT | 3034 |
| 629 | AGCAAAAA A UGCCGCAG | 2737 | CTGCGGCA GGCTAGCTACAACGA TTTTTGCT | 3035 |
| 631 | CAAAAAAU G CCGCAGCC | 2271 | GGCTGCGG GGCTAGCTACAACGA ATTTTTTG | 3036 |
| 634 | AAAAUGCC G CAGCCAAA | 2272 | TTTGGCTG GGCTAGCTACAACGA GGCATTTT | 3037 |
| 637 | AUGCCGCA G CCAAAUUA | 2273 | TAATTTGG GGCTAGCTACAACGA TGCGGCAT | 3038 |
| 642 | GCAGCCAA A UUAGCUGU | 2738 | ACAGCTAA GGCTAGCTACAACGA TTGGCTGC | 3039 |
| 646 | CCAAAUUA G CUGUUGAG | 2274 | CTCAACAG GGCTAGCTACAACGA TAATTTGG | 3040 |
| 649 | AAUUAGCU G UUGAGAUA | 2275 | TATCTCAA GGCTAGCTACAACGA AGCTAATT | 3041 |
| 655 | CUGUUGAG A UACUUAAU | 2739 | ATTAAGTA GGCTAGCTACAACGA CTCAACAG | 3042 |
| 657 | GUUGAGAU A CUUAAUAA | 148 | TTATTAAG GGCTAGCTACAACGA ATCTCAAC | 3043 |
| 662 | GAUACUUA A UAAGGAAA | 2740 | TTTCCTTA GGCTAGCTACAACGA TAAGTATC | 3044 |
| 676 | AAAAGAAG G CAGUUAGU | 2276 | ACTAACTG GGCTAGCTACAACGA CTTCTTTT | 3045 |
| 679 | AGAAGGCA G UUAGUCCU | 2277 | AGGACTAA GGCTAGCTACAACGA TGCCTTCT | 3046 |
| 683 | GGCAGUUA G UCCUUUAU | 2278 | ATAAAGGA GGCTAGCTACAACGA TAACTGCC | 3047 |
| 690 | AGUCCUUU A UUAUUGAC | 157 | GTCAATAA GGCTAGCTACAACGA AAAGGACT | 3048 |
| 693 | CCUUUAUU A UUGACAAC | 159 | GTTGTCAA GGCTAGCTACAACGA AATAAAGG | 3049 |
| 697 | UAUUAUUG A CAACAACG | 2741 | CGTTGTTG GGCTAGCTACAACGA CAATAATA | 3050 |
| 700 | UAUUGACA A CAACGAAU | 2742 | ATTCGTTG GGCTAGCTACAACGA TGTCAATA | 3051 |
| 703 | UGACAACA A CGAAUUCU | 2743 | AGAATTCG GGCTAGCTACAACGA TGTTGTCA | 3052 |
| 707 | AACAACGA A UUCUUCAG | 2744 | CTGAAGAA GGCTAGCTACAACGA TCGTTGTT | 3053 |
| 720 | UCAGAAGG A UUACCAU | 2745 | ATGGATAA GGCTAGCTACAACGA CCTTCTGA | 3054 |
| 723 | GAAGGAUU A UCCAUGGG | 166 | CCCATGGA GGCTAGCTACAACGA AATCCTTC | 3055 |
| 727 | GAUUAUCC A UGGGAAU | 1399 | ATTCCCCA GGCTAGCTACAACGA GGATAATC | 3056 |
| 734 | CAUGGGGA A UUACAUAG | 2746 | CTATGTAA GGCTAGCTACAACGA TCCCCATG | 3057 |
| 737 | GGGGAAUU A CAUAGGCC | 169 | GGCCTATG GGCTAGCTACAACGA AATTCCCC | 3058 |
| 739 | GGAAUUAC A UAGGCCUU | 1400 | AAGGCCTA GGCTAGCTACAACGA GTAATTCC | 3059 |
| 743 | UUACAUAG G CCUUAUCA | 2279 | TGATAAGG GGCTAGCTACAACGA CTATGTAA | 3060 |
| 748 | UAGGCCUU A UCAAUAGA | 172 | TCTATTGA GGCTAGCTACAACGA AAGGCCTA | 3061 |

TABLE XI-continued

Human PKR DNAzyme and Substrate Sequence

| Pos | Substrate | Seq ID | DNAzyme | Seq ID |
|---|---|---|---|---|
| 752 | CCUUAUCA A UAGAAUUG | 2747 | CAATTCTA GGCTAGCTACAACGA TGATAAGG | 3062 |
| 757 | UCAAUAGA A UUGCCCAG | 2748 | CTGGGCAA GGCTAGCTACAACGA TCTATTGA | 3063 |
| 760 | AUAGAAUU G CCCAGAAG | 2280 | CTTCTGGG GGCTAGCTACAACGA AATTCTAT | 3064 |
| 774 | AAGAAAAG C CUAACUGU | 2749 | ACAGTTAG GGCTAGCTACAACGA CTTTTCTT | 3065 |
| 778 | AAAGACUA A CUGUAAAU | 2750 | ATTTACAG GGCTAGCTACAACGA TAGTCTTT | 3066 |
| 781 | GACUAACU G UAAAUUAU | 2281 | ATAATTTA GGCTAGCTACAACGA AGTTAGTC | 3067 |
| 785 | AACUGUAA A UUAUGAAC | 2751 | GTTCATAA GGCTAGCTACAACGA TTACAGTT | 3068 |
| 788 | UGUAAAUU A UGAACAGU | 179 | ACTGTTCA GGCTAGCTACAACGA AATTTACA | 3069 |
| 792 | AAUUAUGA A CAGUGUGC | 2752 | GCACACTG GGCTAGCTACAACGA TCATAATT | 3070 |
| 795 | UAUGAACA G UGUGCAUC | 2282 | GATGCACA GGCTAGCTACAACGA TGTTCATA | 3071 |
| 797 | UGAACAGU G UGCAUCGG | 2283 | CCGATGCA GGCTAGCTACAACGA ACTGTTCA | 3072 |
| 799 | AACAGUGU G CAUCGGGG | 2284 | CCCCGATG GGCTAGCTACAACGA ACACTGTT | 3073 |
| 801 | CAGUGUGC A UCGGGGU | 1410 | ACCCCCGA GGCTAGCTACAACGA GCACACTG | 3074 |
| 808 | CAUCGGGG G UGCAUGGG | 2285 | CCCATGCA GGCTAGCTACAACGA CCCCGATG | 3075 |
| 810 | UCGGGGU G CAUGGGCC | 2286 | GGCCCATG GGCTAGCTACAACGA ACCCCGA | 3076 |
| 812 | GGGGUGC A UGGGCCAG | 1411 | CTGGCCCA GGCTAGCTACAACGA GCACCCCC | 3077 |
| 816 | GUGCAUGG G CCAGAAGG | 2287 | CCTTCTGG GGCTAGCTACAACGA CCATGCAC | 3078 |
| 825 | CCAGAAGG A UUUCAUUA | 2753 | TAATGAAA GGCTAGCTACAACGA CCTTCTGG | 3079 |
| 830 | AGGAUUUC A UUAUAAAU | 1414 | ATTTATAA GGCTAGCTACAACGA GAAATCCT | 3080 |
| 833 | AUUUCAUU A UAAAUGCA | 185 | TGCATTTA GGCTAGCTACAACGA AATGAAAT | 3081 |
| 837 | CAUUAUAA A UGCAAAAU | 2754 | ATTTTGCA GGCTAGCTACAACGA TTATAATG | 3082 |
| 839 | UUAUAAAU G CAAAAUGG | 2288 | CCATTTTG GGCTAGCTACAACGA ATTTATAA | 3083 |
| 844 | AAUGCAAA A UGGGACAG | 2755 | CTGTCCCA GGCTAGCTACAACGA TTTGCATT | 3084 |
| 849 | AAAAUGGG A CAGAAAGA | 2756 | TCTTTCTG GGCTAGCTACAACGA CCCATTTT | 3085 |
| 858 | CAGAAAGA A UAUAGUAU | 2757 | ATACTATA GGCTAGCTACAACGA TCTTTCTG | 3086 |
| 860 | GAAAGAAU A UAGUAUUG | 187 | CAATACTA GGCTAGCTACAACGA ATTCTTTC | 3087 |
| 863 | AGAAUAUA G UAUUGGUA | 2289 | TACCAATA GGCTAGCTACAACGA TATATTCT | 3088 |
| 865 | AAUAUAGU A UUGGUACA | 189 | TGTACCAA GGCTAGCTACAACGA ACTATATT | 3089 |
| 869 | UAGUAUUG G UACAGGUU | 2290 | AACCTGTA GGCTAGCTACAACGA CAATACTA | 3090 |
| 871 | GUAUUGGU A CAGGUUCU | 191 | AGAACCTG GGCTAGCTACAACGA ACCAATAC | 3091 |
| 875 | UGGUACAG G UUCUACUA | 2291 | TAGTAGAA GGCTAGCTACAACGA CTGTACCA | 3092 |
| 880 | CAGGUUCU A CUAAACAG | 194 | CTGTTTAG GGCTAGCTACAACGA AGAACCTG | 3093 |
| 885 | UCUACUAA A CAGGAAGC | 2758 | GCTTCCTG GGCTAGCTACAACGA TTAGTAGA | 3094 |
| 892 | AACAGGAA G CAAAACAA | 2292 | TTGTTTTG GGCTAGCTACAACGA TTCCTGTT | 3095 |
| 897 | GAAGCAAA A CAAUUGGC | 2759 | GCCAATTG GGCTAGCTACAACGA TTTGCTTC | 3096 |
| 900 | GCAAAACA A UUGGCCGC | 2760 | GCGGCCAA GGCTAGCTACAACGA TGTTTTGC | 3097 |
| 904 | AACAAUUG G CCGCUAAA | 2293 | TTTAGCGG GGCTAGCTACAACGA CAATTGTT | 3098 |
| 907 | AAUUGGCC G CUAAACUU | 2294 | AAGTTTAG GGCTAGCTACAACGA GGCCAATT | 3099 |
| 912 | GCCGCUAA A CUUGCAUA | 2761 | TATGCAAG GGCTAGCTACAACGA TTAGCGGC | 3100 |
| 916 | CUAAACUU G CAUAUCUU | 2295 | AAGATATG GGCTAGCTACAACGA AAGTTTAG | 3101 |
| 918 | AAACUUGC A UAUCUUCA | 1426 | TGAAGATA GGCTAGCTACAACGA GCAAGTTT | 3102 |
| 920 | ACUUGCAU A UCUUCAGA | 199 | TCTGAAGA GGCTAGCTACAACGA ATGCAAGT | 3103 |
| 928 | AUCUUCAG A UAUUAUCA | 2762 | TGATAATA GGCTAGCTACAACGA CTGAAGAT | 3104 |
| 930 | CUUCAGAU A UUAUCAGA | 203 | TCTGATAA GGCTAGCTACAACGA ATCTGAAG | 3105 |
| 933 | CAGAUAUU A UCAGAAGA | 205 | TCTTCTGA GGCTAGCTACAACGA AATATCTG | 3106 |
| 943 | CAGAAGAA A CCUCAGUG | 2763 | CACTGAGG GGCTAGCTACAACGA TTCCTTCTG | 3107 |
| 949 | AAACCUCA G UGAAAUCU | 2296 | AGATTTCA GGCTAGCTACAACGA TGAGGTTT | 3108 |
| 954 | UCAGUGAA A UCUGACUA | 2764 | TAGTCAGA GGCTAGCTACAACGA TTCACTGA | 3109 |
| 959 | GAAAUCUG A CUACCUGU | 2765 | ACAGGTAG GGCTAGCTACAACGA CAGATTTC | 3110 |
| 962 | AUCUGACU A CCUGUCCU | 209 | AGGACAGG GGCTAGCTACAACGA AGTCAGAT | 3111 |
| 966 | GACUACCU G UCCUCUGG | 2297 | CCAGAGGA GGCTAGCTACAACGA AGGTAGTC | 3112 |
| 974 | GUCCUCUG G UUCUUUUG | 2298 | CAAAAGAA GGCTAGCTACAACGA CAGAGGAC | 3113 |
| 982 | GUUCUUUU G CUACUACG | 2299 | CGTAGTAG GGCTAGCTACAACGA AAAAGAAC | 3114 |
| 985 | CUUUUGCU A CUACGUGU | 217 | ACACGTAG GGCTAGCTACAACGA AGCAAAAG | 3115 |
| 988 | UUGCUACU A CGUGUGAG | 218 | CTCACACG GGCTAGCTACAACGA AGTAGCAA | 3116 |
| 990 | GCUACUAC G UGUGAGUC | 2300 | GACTCACA GGCTAGCTACAACGA GTAGTAGC | 3117 |
| 992 | UACUACGU G UGAGUCCC | 2301 | GGGACTCA GGCTAGCTACAACGA ACGTAGTA | 3118 |
| 996 | ACGUGUGA G UCCCAAAG | 2302 | CTTTGGGA GGCTAGCTACAACGA TCACACGT | 3119 |
| 1004 | GUCCCAAA G CAACUCUU | 2303 | AAGAGTTG GGCTAGCTACAACGA TTTGGGAC | 3120 |
| 1007 | CCAAAGCA A CUCUUUAG | 2766 | CTAAAGAG GGCTAGCTACAACGA TGCTTTGG | 3121 |
| 1015 | ACUCUUUA G UGACCAGC | 2304 | GCTGGTCA GGCTAGCTACAACGA TAAAGAGT | 3122 |
| 1018 | CUUUAGUG A CCAGCACA | 2767 | TGTGCTGG GGCTAGCTACAACGA CACTAAAG | 3123 |
| 1022 | AGUGACCA G CACACUCG | 2305 | CGAGTGTG GGCTAGCTACAACGA TGGTCACT | 3124 |
| 1024 | UGACCAGC A CACUCGCU | 1451 | AGCGAGTG GGCTAGCTACAACGA GCTGGTCA | 3125 |
| 1026 | ACCAGCAC A CUCGCUUC | 1452 | GAAGCGAG GGCTAGCTACAACGA GTGCTGGT | 3126 |
| 1030 | GCACACUC G CUUCUGAA | 2306 | TTCAGAAG GGCTAGCTACAACGA GAGTGTGC | 3127 |
| 1038 | GCUUCUGA A UCAUCAUC | 2768 | GATGATGA GGCTAGCTACAACGA TCAGAAGC | 3128 |
| 1041 | UCUGAAUC A UCAUCUGA | 1456 | TCAGATGA GGCTAGCTACAACGA GATTCAGA | 3129 |
| 1044 | GAAUCAUC A UCUGAAGG | 1457 | CCTTCAGA GGCTAGCTACAACGA GATGATTC | 3130 |
| 1052 | AUCUGAAG G UGACUUCU | 2307 | AGAAGTCA GGCTAGCTACAACGA CTTCAGAT | 3131 |
| 1055 | UGAAGGUG A CUUCUCAG | 2769 | CTGAGAAG GGCTAGCTACAACGA CACCTTCA | 3132 |
| 1063 | ACUUCUCA G CAGAUACA | 2308 | TGTATCTG GGCTAGCTACAACGA TGAGAAGT | 3133 |
| 1067 | CUCAGCAG A UACAUCAG | 2770 | CTGATGTA GGCTAGCTACAACGA CTGCTGAG | 3134 |
| 1069 | CAGCAGAU A CAUCAGAG | 233 | CTCTGATG GGCTAGCTACAACGA ATCTGCTG | 3135 |
| 1071 | GCAGAUAC A UCAGAGAU | 1463 | ATCTCTGA GGCTAGCTACAACGA GTATCTGC | 3136 |

TABLE XI-continued

Human PKR DNAzyme and Substrate Sequence

| Pos | Substrate | Seq ID | DNAzyme | Seq ID |
|---|---|---|---|---|
| 1078 | CAUCAGAG A UAAAUUCU | 2771 | AGAATTTA GGCTAGCTACAACGA CTCTGATG | 3137 |
| 1082 | AGAGAUAA A UUCUAACA | 2772 | TGTTAGAA GGCTAGCTACAACGA TTATCTCT | 3138 |
| 1088 | AAAUUCUA A CAGUGACA | 2773 | TGTCACTG GGCTAGCTACAACGA TAGAATTT | 3139 |
| 1091 | UUCUAACA G UGACAGUU | 2309 | AACTGTCA GGCTAGCTACAACGA TGTTAGAA | 3140 |
| 1094 | UAACAGUG A CAGUUUAA | 2774 | TTAAACTG GGCTAGCTACAACGA CACTGTTA | 3141 |
| 1097 | CAGUGACA G UUUAAACA | 2310 | TGTTTAAA GGCTAGCTACAACGA TGTCACTG | 3142 |
| 1103 | CAGUUUAA A CAGUUCUU | 2775 | AAGAACTG GGCTAGCTACAACGA TTAAACTG | 3143 |
| 1106 | UUUAAACA G UUCUUCGU | 2311 | ACGAAGAA GGCTAGCTACAACGA TGTTTAAA | 3144 |
| 1113 | AGUUCUUC G UUGCUUAU | 2312 | ATAAGCAA GGCTAGCTACAACGA GAAGAACT | 3145 |
| 1116 | UCUUCGUU G CUUAUGAA | 2313 | TTCATAAG GGCTAGCTACAACGA AACGAAGA | 3146 |
| 1120 | CGUUGCUU A UGAAUGGU | 248 | ACCATTCA GGCTAGCTACAACGA AAGCAACG | 3147 |
| 1124 | GCUUAUGA A UGGUCUCA | 2776 | TGAGACCA GGCTAGCTACAACGA TCATAAGC | 3148 |
| 1127 | UAUGAAUG G UCUCAGAA | 2314 | TTCTGAGA GGCTAGCTACAACGA CATTCATA | 3149 |
| 1136 | UCUCAGAA A UAAUCAAA | 2777 | TTTGATTA GGCTAGCTACAACGA TTCTGAGA | 3150 |
| 1139 | CAGAAAUA A UCAAAGGA | 2778 | TCCTTTGA GGCTAGCTACAACGA TATTTCTG | 3151 |
| 1150 | AAAGGAAG C AAAAAGA | 2315 | TCTTTTTG GGCTAGCTACAACGA CTTCCTTT | 3152 |
| 1158 | GCAAAAAG A UCUUUGGC | 2779 | GCCAAAGA GGCTAGCTACAACGA CTTTTTGC | 3153 |
| 1165 | GAUCUUUG G CACCCAGA | 2316 | TCTGGGTG GGCTAGCTACAACGA CAAAGATC | 3154 |
| 1167 | UCUUUGGC A CCCAGAUU | 1476 | AATCTGGG GGCTAGCTACAACGA GCCAAAGA | 3155 |
| 1173 | GCACCCAG A UUUGACCU | 2780 | AGGTCAAA GGCTAGCTACAACGA CTGGGTGC | 3156 |
| 1178 | CAGAUUUG A CCUUCCUG | 2781 | CAGGAAGG GGCTAGCTACAACGA CAAATCTG | 3157 |
| 1187 | CCUUCCUG A CAUGAAAG | 2782 | CTTTCATG GGCTAGCTACAACGA CAGGAAGG | 3158 |
| 1189 | UUCCUGAC A UGAAAGAA | 1484 | TTCTTTCA GGCTAGCTACAACGA GTCAGGAA | 3159 |
| 1198 | UGAAAGAA A CAAAGUAU | 2783 | ATACTTTG GGCTAGCTACAACGA TTCTTTCA | 3160 |
| 1203 | GAAACAAA G UAUACUGU | 2317 | ACAGTATA GGCTAGCTACAACGA TTTGTTTC | 3161 |
| 1205 | AACAAAGU A UACUGUGG | 260 | CCACAGTA GGCTAGCTACAACGA ACTTTGTT | 3162 |
| 1207 | CAAAGUAU A CUGUGGAC | 261 | GTCCACAG GGCTAGCTACAACGA ATACTTTG | 3163 |
| 1210 | AGUAUACU G UGGACAAG | 2318 | CTTGTCCA GGCTAGCTACAACGA AGTATACT | 3164 |
| 1214 | UACUGUGG A CAAGAGGU | 2784 | ACCTCTTG GGCTAGCTACAACGA CCACAGTA | 3165 |
| 1221 | GACAAGAG G UUUGGCAU | 2319 | ATGCCAAA GGCTAGCTACAACGA CTCTTGTC | 3166 |
| 1226 | GAGGUUUG G CAUGGAUU | 2320 | AATCCATG GGCTAGCTACAACGA CAAACCTC | 3167 |
| 1228 | GGUUUGGC A UGGAUUUU | 1488 | AAAATCCA GGCTAGCTACAACGA GCCAAACC | 3168 |
| 1232 | UGGCAUGG A UUUUAAAG | 2785 | CTTTAAAA GGCTAGCTACAACGA CCATGCCA | 3169 |
| 1243 | UUAAGAA A UAGAAUUA | 2786 | TAATTCTA GGCTAGCTACAACGA TTCTTTAA | 3170 |
| 1248 | GAAAUAGA A UUAAUUGG | 2787 | CCAATTAA GGCTAGCTACAACGA TCTATTTC | 3171 |
| 1252 | UAGAAUUA A UUGGCUCA | 2788 | TGAGCCAA GGCTAGCTACAACGA TAATTCTA | 3172 |
| 1256 | AUUAAUUG G CUCAGGUG | 2321 | CACCTGAG GGCTAGCTACAACGA CAATTAAT | 3173 |
| 1262 | UGGCUCAG G UGGAUUUG | 2322 | CAAATCCA GGCTAGCTACAACGA CTGAGCCA | 3174 |
| 1266 | UCAGGUGG A UUUGGCCA | 2789 | TGGCCAAA GGCTAGCTACAACGA CCACCTGA | 3175 |
| 1271 | UGGAUUUG G CCAAGUUU | 2323 | AAACTTGG GGCTAGCTACAACGA CAAATCCA | 3176 |
| 1276 | UUGGCCAA G UUUCUAAA | 2324 | TTTGAAAA GGCTAGCTACAACGA TTGGCCAA | 3177 |
| 1285 | UUUUCAAA G CAAAACAC | 2325 | GTGTTTTG GGCTAGCTACAACGA TTTGAAAA | 3178 |
| 1290 | AAAGCAAA A CACAGAAU | 2790 | ATTCTGTG GGCTAGCTACAACGA TTTGCTTT | 3179 |
| 1292 | AGCAAAAC A CAGAAUUG | 1495 | CAATTCTG GGCTAGCTACAACGA GTTTTGCT | 3180 |
| 1297 | AACACAGA A UUGACGGU | 2791 | TCCGTCAA GGCTAGCTACAACGA TCTGTGTT | 3181 |
| 1301 | CAGAAUUG A CGGAAGA | 2792 | TCTTTCCG GGCTAGCTACAACGA CAATTCTG | 3182 |
| 1309 | ACGGAAAG A CUUACGUU | 2793 | AACGTAAG GGCTAGCTACAACGA CTTTCCGT | 3183 |
| 1313 | AAAGACUU A CGUUAUUA | 281 | TAATAACG GGCTAGCTACAACGA AAGTCTTT | 3184 |
| 1315 | AGACUUAC G UUAUUAAA | 2326 | TTTAATAA GGCTAGCTACAACGA GTAAGTCT | 3185 |
| 1318 | CUUACGUU A UUAAACGU | 283 | ACGTTTAA GGCTAGCTACAACGA AACGTAAG | 3186 |
| 1323 | GUUAUUAA A CGUGUUAA | 2794 | TTAACACG GGCTAGCTACAACGA TTAATAAC | 3187 |
| 1325 | UAUUAAAC G UGUUAAUA | 2327 | ATTTAACA GGCTAGCTACAACGA GTTTAATA | 3188 |
| 1327 | UUAAACGU G UUAAAUAU | 2328 | ATATTTAA GGCTAGCTACAACGA ACGTTTAA | 3189 |
| 1332 | CGUGUUAA A UAUAAUA | 2795 | TTATTATA GGCTAGCTACAACGA TTAACACG | 3190 |
| 1334 | UGUUAAAU A UAAUAACG | 288 | CGTTATTA GGCTAGCTACAACGA ATTTAACA | 3191 |
| 1337 | UAAAUAUA A UAACGAGA | 2796 | TCTCGTTA GGCTAGCTACAACGA TATATTTA | 3192 |
| 1340 | AUAUAAUA A CGAGAAGG | 2797 | CCTTCTCG GGCTAGCTACAACGA TATTATAT | 3193 |
| 1348 | ACGAGAAG G CGGACGCGU | 2329 | ACGCTCCG GGCTAGCTACAACGA CTTCTCGT | 3194 |
| 1353 | AAGGCGGA G CGUGAAGU | 2330 | ACTTCACG GGCTAGCTACAACGA TCCGCCTT | 3195 |
| 1355 | GGCGGAGC G UGAAGUAA | 2331 | TTACTTCA GGCTAGCTACAACGA GCTCCGCC | 3196 |
| 1360 | AGCGUGAA G UAAAAGCA | 2332 | TGCTTTTA GGCTAGCTACAACGA TTCACGCT | 3197 |
| 1366 | AAGUAAAA G CAUUGGCA | 2333 | TGCCAATG GGCTAGCTACAACGA TTTTACTT | 3198 |
| 1368 | GUAAAAGC A UUGGCAAA | 1498 | TTTGCCAA GGCTAGCTACAACGA GCTTTTAC | 3199 |
| 1372 | AAGCAUUG G CAAACUU | 2334 | AAGTTTTG GGCTAGCTACAACGA CAATGCTT | 3200 |
| 1377 | UUGGCAAA A CUUGAUCA | 2798 | TGATCAAG GGCTAGCTACAACGA TTTGCCAA | 3201 |
| 1382 | AAAACUUG A UCAUGUAA | 2799 | TTACATGA GGCTAGCTACAACGA CAAGTTTT | 3202 |
| 1385 | ACUUGAUC A UGUAAAUA | 1501 | TATTTACA GGCTAGCTACAACGA GATCAAGT | 3203 |
| 1387 | UUGAUCAU G UAAAUAUU | 2335 | AATATTTA GGCTAGCTACAACGA ATGATCAA | 3204 |
| 1391 | UCAUGUAA A UAUUGUUC | 2800 | GAACAATA GGCTAGCTACAACGA TTACATGA | 3205 |
| 1393 | AUGUAAAU A UUGUUCAC | 296 | GTGAACAA GGCTAGCTACAACGA ATTTACAT | 3206 |
| 1396 | UAAAUAUU G UUCACUAC | 2336 | GTAGTGAA GGCTAGCTACAACGA AATATTTA | 3207 |
| 1400 | UAUUGUUC A CUACAAUG | 1502 | CATTGTAG GGCTAGCTACAACGA GAACAATA | 3208 |
| 1403 | UGUUCACU A CAAUGGCU | 300 | AGCCATTG GGCTAGCTACAACGA AGTGAACA | 3209 |
| 1406 | UCACUACA A UGGCUGUU | 2801 | AACAGCCA GGCTAGCTACAACGA TGTAGTGA | 3210 |
| 1409 | CUACAAUG G CUGUUGGG | 2337 | CCCAACAG GGCTAGCTACAACGA CATTGTAG | 3211 |

TABLE XI-continued

Human PKR DNAzyme and Substrate Sequence

| Pos | Substrate | Seq ID | DNAzyme | Seq ID |
|---|---|---|---|---|
| 1412 | CAAUGGCU G UUGGGAUG | 2338 | CATCCCAA GGCTAGCTACAACGA AGCCATTG | 3212 |
| 1418 | CUGUUGGG A UGGAUUUG | 2802 | CAAATCCA GGCTAGCTACAACGA CCCAACAG | 3213 |
| 1422 | UGGGAUGG A UUUGAUUA | 2803 | TAATCAAA GGCTAGCTACAACGA CCATCCCA | 3214 |
| 1427 | UGGAUUUG A UUAUGAUC | 2804 | GATCATAA GGCTAGCTACAACGA CAAATCCA | 3215 |
| 1430 | AUUUGAUU A UGAUCCUG | 305 | CAGGATCA GGCTAGCTACAACGA AATCAAAT | 3216 |
| 1433 | UGAUUAUG A UCCUGAGA | 2805 | TCTCAGGA GGCTAGCTACAACGA CATAATCA | 3217 |
| 1441 | AUCCUGAG A CCAGUGAU | 2806 | ATCACTGG GGCTAGCTACAACGA CTCAGGAT | 3218 |
| 1445 | UGAGACCA G UGAUGAUU | 2339 | AATCATCA GGCTAGCTACAACGA TGGTCTCA | 3219 |
| 1448 | GACCAGUG A UGAUUCUC | 2807 | GAGAATCA GGCTAGCTACAACGA CACTGGTC | 3220 |
| 1451 | CAGUGAUG A UUCUCUUG | 2808 | CAAGAGAA GGCTAGCTACAACGA CATCACTG | 3221 |
| 1463 | UCUUGAGA G CAGUGAUU | 2340 | AATCACTG GGCTAGCTACAACGA TCTCAAGA | 3222 |
| 1466 | UGAGCA G UGAUUAUG | 2341 | CATAATCA GGCTAGCTACAACGA TGCTCTCA | 3223 |
| 1469 | GAGCAGUG A UUAUGAUC | 2809 | GATCATAA GGCTAGCTACAACGA CACTGCTC | 3224 |
| 1472 | CAGUGAUU A UGAUCCUG | 312 | CAGGATCA GGCTAGCTACAACGA AATCACTG | 3225 |
| 1475 | UGAUUAUG A UCCUGAGA | 2805 | TCTCAGGA GGCTAGCTACAACGA CATAATCA | 3217 |
| 1484 | UCCUGAGA A CAGCAAAA | 2810 | TTTTGCTG GGCTAGCTACAACGA TCTCAGGA | 3226 |
| 1487 | UGAGAACA G CAAAAAUA | 2342 | TATTTTTG GGCTAGCTACAACGA TGTTCTCA | 3227 |
| 1493 | CAGCAAAA A UAGUUCAA | 2811 | TTGAACTA GGCTAGCTACAACGA TTTTGCTG | 3228 |
| 1496 | CAAAAAUA G UUCAAGGU | 2343 | ACCTTGAA GGCTAGCTACAACGA TATTTTTG | 3229 |
| 1503 | AGUUCAAG G UCAAAGAC | 2344 | GTCTTTGA GGCTAGCTACAACGA CTTGAACT | 3230 |
| 1510 | GGUCAAAG A CUAAGUGC | 2812 | GCACTTAG GGCTAGCTACAACGA CTTTGACC | 3231 |
| 1515 | AAGACUAA G UGCCUUUU | 2345 | AAAAGGCA GGCTAGCTACAACGA TTAGTCTT | 3232 |
| 1517 | GACUAAGU G CCUUUUCA | 2346 | TGAAAAGG GGCTAGCTACAACGA ACTTAGTC | 3233 |
| 1525 | GCCUUUUC A UCCAAAUG | 1522 | CATTTGGA GGCTAGCTACAACGA GAAAAGGC | 3234 |
| 1531 | UCAUCCAA A UGGAAUUC | 2813 | GAATTCCA GGCTAGCTACAACGA TTGGATGA | 3235 |
| 1536 | CAAAUGGA A UUCUGUGA | 2814 | TCACAGAA GGCTAGCTACAACGA TCCATTTG | 3236 |
| 1541 | GGAAUUCU G UGAUAAAG | 2347 | CTTTATCA GGCTAGCTACAACGA AGAATTCC | 3237 |
| 1544 | AUUCUGUG A UAAAGGGA | 2815 | TCCCTTTA GGCTAGCTACAACGA CACAGAAT | 3238 |
| 1552 | AUAAAGGG A CCUUGGAA | 2816 | TTCCAAGG GGCTAGCTACAACGA CCCTTTAT | 3239 |
| 1560 | ACCUUGGA A CAAUGGAU | 2817 | ATCCATTG GGCTAGCTACAACGA TCCAAGGT | 3240 |
| 1563 | UUGGAACA A UGGAUUGA | 2818 | TCAATCCA GGCTAGCTACAACGA TGTTCCAA | 3241 |
| 1567 | AACAAUGG A UUGAAAAA | 2819 | TTTTTCAA GGCTAGCTACAACGA CCATTGTT | 3242 |
| 1583 | AAGAAGAG A CGAGAAAC | 2348 | GTTTCTCG GGCTAGCTACAACGA CTCTTCTT | 3243 |
| 1590 | GGCGAGAA A CUAGACAA | 2820 | TTGTCTAG GGCTAGCTACAACGA TTCTCGCC | 3244 |
| 1595 | GAAACUAG A CAAAGUUU | 2821 | AAACTTTG GGCTAGCTACAACGA CTAGTTTC | 3245 |
| 1600 | UAGACAAA G UUUUGGCU | 2349 | AGCCAAAA GGCTAGCTACAACGA TTTGTCTA | 3246 |
| 1606 | AAGUUUUG G CUUUGGAA | 2350 | TTCCAAAG GGCTAGCTACAACGA CAAAACTT | 3247 |
| 1614 | GCUUUGGA A CUCUUUGA | 2822 | TCAAGAG GGCTAGCTACAACGA TCCAAAGC | 3248 |
| 1623 | CUCUUUGA A CAAAUAAC | 2823 | GTTATTTG GGCTAGCTACAACGA TCAAAGAG | 3249 |
| 1627 | UUGAACAA A UAACAAAA | 2824 | TTTTGTTA GGCTAGCTACAACGA TTGTTCAA | 3250 |
| 1630 | AACAAAUA A CAAAAGGG | 2825 | CCCTTTTG GGCTAGCTACAACGA TATTTGTT | 3251 |
| 1639 | CAAAAGGG G UGGAUUAU | 2351 | ATAATCCA GGCTAGCTACAACGA CCCTTTTG | 3252 |
| 1643 | AGGGUGG A UUAUAUAC | 2826 | GTATATAA GGCTAGCTACAACGA CCACCCCT | 3253 |
| 1646 | GGUGGAUU A UAUACAUU | 340 | AATGTATA GGCTAGCTACAACGA AATCCACC | 3254 |
| 1648 | UGGAUUAU A UACAUUCA | 341 | TGAATGTA GGCTAGCTACAACGA ATAATCCA | 3255 |
| 1650 | GAUUAUAU A CAUUCAAA | 342 | TTTGAATG GGCTAGCTACAACGA ATATAATC | 3256 |
| 1652 | UUAUAUAC A UUCAAAAA | 1536 | TTTTTGAA GGCTAGCTACAACGA GTATATAA | 3257 |
| 1662 | UCAAAAAA A UUAAUUCA | 2827 | TGAATTAA GGCTAGCTACAACGA TTTTTTGA | 3258 |
| 1666 | AAAAUUA A UUCAUAGA | 2828 | TCTATGAA GGCTAGCTACAACGA TAATTTTT | 3259 |
| 1670 | AUUAAUUC A UAGAGAUC | 1538 | GATCTCTA GGCTAGCTACAACGA GAATTAAT | 3260 |
| 1676 | UCAUAGAG A UCUUAAGC | 2829 | GCTTAAGA GGCTAGCTACAACGA CTCTATGA | 3261 |
| 1683 | GAUCUUAA G CCAAGUAA | 2352 | TTACTTGG GGCTAGCTACAACGA TTAAGATC | 3262 |
| 1688 | UAAGCCAA G UAAUAUAU | 2353 | ATATATTA GGCTAGCTACAACGA TTGGCTTA | 3263 |
| 1691 | GCCAAGUA A UAUAUUCU | 2830 | AGAATATA GGCTAGCTACAACGA TACTTGGC | 3264 |
| 1693 | CAAGUAAU A UAUUCUUA | 354 | TAAGAATA GGCTAGCTACAACGA ATTACTTG | 3265 |
| 1695 | AGUAAUAU A UUCUUAGU | 355 | ACTAAGAA GGCTAGCTACAACGA ATATTACT | 3266 |
| 1702 | UAUUCUUA G UAGAUACA | 2354 | TGTATCTA GGCTAGCTACAACGA TAAGAATA | 3267 |
| 1706 | CUUAGUAG A UACAAAAC | 2831 | GTTTTGTA GGCTAGCTACAACGA CTACTAAG | 3268 |
| 1708 | UAGAGAU A CAAAACAA | 361 | TTGTTTTG GGCTAGCTACAACGA ATCTACTA | 3269 |
| 1713 | GAUACAAA A CAAGUAAA | 2832 | TTTACTTG GGCTAGCTACAACGA TTTGTATC | 3270 |
| 1717 | CAAAACAA G UAAAGAUU | 2355 | AATCTTTA GGCTAGCTACAACGA TTGTTTTG | 3271 |
| 1723 | AAGUAAAG A UUGGAGAC | 2833 | GTCTCCAA GGCTAGCTACAACGA CTTTACTT | 3272 |
| 1730 | GAUUGGAG A CUUUGGAC | 2834 | GTCCAAAG GGCTAGCTACAACGA CTCCAATC | 3273 |
| 1737 | GACUUUGG A CUUGUAAC | 2835 | GTTACAAG GGCTAGCTACAACGA CCAAAGTC | 3274 |
| 1741 | UUGGACUU G UAACAUCU | 2356 | AGATGTTA GGCTAGCTACAACGA AAGTCCAA | 3275 |
| 1744 | GACUUGUA A CAUCUCUG | 2836 | CAGAGATG GGCTAGCTACAACGA TACAAGTC | 3276 |
| 1746 | CUUGUAAC A UCUCUGAA | 1547 | TTCAGAGA GGCTAGCTACAACGA GTTACAAG | 3277 |
| 1757 | UCUGAAAA A UGAUGGAA | 2837 | TTCCATCA GGCTAGCTACAACGA TTTTCAGA | 3278 |
| 1760 | GAAAAAUG A UGGAAAGC | 2838 | GCTTTCCA GGCTAGCTACAACGA CATTTTTC | 3279 |
| 1767 | GAUGGAA G CGAACAAG | 2357 | CTTGTTCG GGCTAGCTACAACGA TTTCCATC | 3280 |
| 1771 | GAAAGCGA A CAAGGAGU | 2839 | ACTCCTTG GGCTAGCTACAACGA TCGCTTTC | 3281 |
| 1778 | AACAAGGA G UAAGGAA | 2358 | TTCCCTTA GGCTAGCTACAACGA TCCTTGTT | 3282 |
| 1786 | GUAAGGGA A CUUUGCGA | 2840 | TCGCAAAG GGCTAGCTACAACGA TCCCTTAC | 3283 |
| 1791 | GGAACUUU G CGAUACAU | 2359 | ATGTATCG GGCTAGCTACAACGA AAAGTTCC | 3284 |
| 1794 | ACUUUGCG A UACAUGAG | 2841 | CTCATGTA GGCTAGCTACAACGA CGCAAAGT | 3285 |

TABLE XI-continued

Human PKR DNAzyme and Substrate Sequence

| Pos | Substrate | Seq ID | DNAzyme | Seq ID |
|---|---|---|---|---|
| 1796 | UUUGCGAU A CAUGAGCC | 373 | GGCTCATG GGCTAGCTACAACGA ATCGCAAA | 3286 |
| 1798 | UGCGAUAC A UGAGCCCA | 1552 | TGGGCTCA GGCTAGCTACAACGA GTATCGCA | 3287 |
| 1802 | AUACAUGA G CCCAGAAC | 2360 | GTTCTGGG GGCTAGCTACAACGA TCATGTAT | 3288 |
| 1809 | AGCCCAGA A CAGAUUUC | 2842 | GAAATCTG GGCTAGCTACAACGA TCTGGGCT | 3289 |
| 1813 | CAGAACAG A UUUCUUCG | 2843 | CGAAGAAA GGCTAGCTACAACGA CTGTTCTG | 3290 |
| 1821 | AUUUCUUC G CAAGACUA | 2361 | TAGTCTTG GGCTAGCTACAACGA GAAGAAAT | 3291 |
| 1826 | UUCGCAAG A CUAUGGAA | 2844 | TTCCATAG GGCTAGCTACAACGA CTTGCGAA | 3292 |
| 1829 | GCAAGACU A UGGAAAGG | 379 | CCTTTCCA GGCTAGCTACAACGA AGTCTTGC | 3293 |
| 1840 | GAAAGGAA G UGGACCUC | 2362 | GAGGTCCA GGCTAGCTACAACGA TTCCTTTC | 3294 |
| 1844 | GGAAGUGG A CCUCUACG | 2845 | CGTAGAGG GGCTAGCTACAACGA CCACTTCC | 3295 |
| 1850 | GGACCUCU A CGCUUUGG | 381 | CCAAAGCG GGCTAGCTACAACGA AGAGGTCC | 3296 |
| 1852 | ACCUCUAC G CUUUGGGG | 2363 | CCCCAAAG GGCTAGCTACAACGA GTAGAGGT | 3297 |
| 1860 | GCUUUGGG G CUAAUUCU | 2364 | AGAATTAG GGCTAGCTACAACGA CCCAAAGC | 3298 |
| 1864 | UGGGGCUA A UUCUUGCU | 2846 | AGCAAGAA GGCTAGCTACAACGA TAGCCCCA | 3299 |
| 1870 | UAAUUCUU G CUGAACUU | 2365 | AAGTTCAG GGCTAGCTACAACGA AAGAATTA | 3300 |
| 1875 | CUUGCUGA A CUUCUUCA | 2847 | TGAAGAAG GGCTAGCTACAACGA TCAGCAAG | 3301 |
| 1883 | ACUUCUUC A UGUAUGUG | 1569 | CACATACA GGCTAGCTACAACGA GAAGAAGT | 3302 |
| 1885 | UUCUUCAU G UAUGUGAC | 2366 | GTCACATA GGCTAGCTACAACGA ATGAAGAA | 3303 |
| 1887 | CUUCAUGU A UGUGACAC | 392 | GTGTCACA GGCTAGCTACAACGA ACATGAAG | 3304 |
| 1889 | UCAUGUAU G UGACACUG | 2367 | CAGTGTCA GGCTAGCTACAACGA ATACATGA | 3305 |
| 1892 | UGUAUGUG A CACUGCUU | 2848 | AAGCAGTG GGCTAGCTACAACGA CACATACA | 3306 |
| 1894 | UAUGUGAC A CUGCUUUU | 1570 | AAAAGCAG GGCTAGCTACAACGA GTCACATA | 3307 |
| 1897 | GUGACACU G CUUUUGAA | 2368 | TTCAAAAG GGCTAGCTACAACGA AGTGTCAC | 3308 |
| 1906 | CUUUUGAA A CAUCAAAG | 2849 | CTTTGATG GGCTAGCTACAACGA TTCAAAAG | 3309 |
| 1908 | UUUGAAAC A UCAAAGUU | 1573 | AACTTTGA GGCTAGCTACAACGA GTTTCAAA | 3310 |
| 1914 | ACAUCAAA G UUUUUCAC | 2369 | GTGAAAAA GGCTAGCTACAACGA TTTGATGT | 3311 |
| 1921 | AGUUUUUC A CAGACCUA | 1575 | TAGGTCTG GGCTAGCTACAACGA GAAAAACT | 3312 |
| 1925 | UUUCACAG A CCUACGGG | 2850 | CCCGTAGG GGCTAGCTACAACGA CTGTGAAA | 3313 |
| 1929 | ACAGACCU A CGGGAUGG | 402 | CCATCCCG GGCTAGCTACAACGA AGGTCTGT | 3314 |
| 1934 | CCUACGGG A UGGCAUCA | 2851 | TGATGCCA GGCTAGCTACAACGA CCCGTAGG | 3315 |
| 1937 | ACGGGAUG G CAUCAUCU | 2370 | AGATGATG GGCTAGCTACAACGA CATCCCGT | 3316 |
| 1939 | GGGAUGGC A UCAUCUCA | 1579 | TGAGATGA GGCTAGCTACAACGA GCCATCCC | 3317 |
| 1942 | AUGGCAUC A UCUCAGAU | 1580 | ATCTGAGA GGCTAGCTACAACGA GATGCCAT | 3318 |
| 1949 | CAUCUCAG A UAUAUUUG | 2852 | CAAATATA GGCTAGCTACAACGA CTGAGATG | 3319 |
| 1951 | UCUCAGAU A UAUUUGAU | 406 | ATCAAATA GGCTAGCTACAACGA ATCTGAGA | 3320 |
| 1953 | UCAGAUAU A UUUGAUAA | 407 | TTATCAAA GGCTAGCTACAACGA ATATCTGA | 3321 |
| 1958 | UAUAUUUG A UAAAAAG | 2853 | CTTTTTTA GGCTAGCTACAACGA CAAATATA | 3322 |
| 1972 | AAGAAAAA A CUCUUCUA | 2854 | TAGAAGAG GGCTAGCTACAACGA TTTTTCTT | 3323 |
| 1980 | ACUCUUCU A CAGAAAUU | 414 | AATTTCTG GGCTAGCTACAACGA AGAAGAGT | 3324 |
| 1986 | CUACAGAA A UUACUCUC | 2855 | GAGAGTAA GGCTAGCTACAACGA TTCTGTAG | 3325 |
| 1989 | CAGAAAUU A CUCUCAAA | 416 | TTTGAGAG GGCTAGCTACAACGA AATTTCTG | 3326 |
| 2001 | UCAAAGAA A CCUGAGGA | 2856 | TCCTCAGG GGCTAGCTACAACGA TTCTTTGA | 3327 |
| 2009 | ACCUGAGG A UCGACCUA | 2857 | TAGGTCGA GGCTAGCTACAACGA CCTCAGGT | 3328 |
| 2013 | GAGGAUCG A CCUAACAC | 2858 | GTGTTAGG GGCTAGCTACAACGA CGATCCTC | 3329 |
| 2018 | UCGACCUA A CACAUCUG | 2859 | CAGATGTG GGCTAGCTACAACGA TAGGTCGA | 3330 |
| 2020 | GACCUAAC A CAUCUGAA | 1594 | TTCAGATG GGCTAGCTACAACGA GTTAGGTC | 3331 |
| 2022 | CCUAACAC A UCUGAAAU | 1595 | ATTTCAGA GGCTAGCTACAACGA GTGTTAGG | 3332 |
| 2029 | CAUCUGAA A UACUAAGG | 2860 | CCTTAGTA GGCTAGCTACAACGA TTCAGATG | 3333 |
| 2031 | UCUGAAAU A CUAAGGAC | 422 | GTCCTTAG GGCTAGCTACAACGA ATTTCAGA | 3334 |
| 2038 | UACUAAGG A CCUUGACU | 2861 | AGTCAAGG GGCTAGCTACAACGA CCTTAGTA | 3335 |
| 2044 | GGACCUUG A CUGUGUGG | 2862 | CCACACAG GGCTAGCTACAACGA CAAGGTCC | 3336 |
| 2047 | CCUUGACU G UGGAAG | 2371 | CTTCCACA GGCTAGCTACAACGA AGTCAAGG | 3337 |
| 2049 | UUGACUGU G UGGAAGAA | 2372 | TTCTTCCA GGCTAGCTACAACGA ACAGTCAA | 3338 |
| 2060 | GAAGAAAA G CCCAGAGA | 2373 | TCTCTGGG GGCTAGCTACAACGA TTTTCTTC | 3339 |
| 2072 | AGAGAAAA A UGAACGAC | 2863 | GTCGTTCA GGCTAGCTACAACGA TTTTCTCT | 3340 |
| 2076 | AAAAUGA A CGACACAUG | 2864 | GTGTGTCG GGCTAGCTACAACGA TCATTTTT | 3341 |
| 2079 | AAUGAACG A CACACAUG | 2865 | CATGTGTG GGCTAGCTACAACGA CGTTCATT | 3342 |
| 2081 | UGAACGAC A CACAUGUU | 1604 | AACATGTG GGCTAGCTACAACGA GTCGTTCA | 3343 |
| 2083 | AACGACAC A CAUGUUAG | 1605 | CTAACATG GGCTAGCTACAACGA GTGTCGTT | 3344 |
| 2085 | CGACACAC A UGUUAGAG | 1606 | CTCTAACA GGCTAGCTACAACGA GTGTGTCG | 3345 |
| 2087 | ACACACAU G UUAGAGCC | 2374 | GGCTCTAA GGCTAGCTACAACGA ATGTGTGT | 3346 |
| 2093 | AUGUUAGA G CCCUUCUG | 2375 | CAGAAGGG GGCTAGCTACAACGA TCTAACAT | 3347 |
| 2107 | CUGAAAAA G UAUCCUGC | 2376 | GCAGGATA GGCTAGCTACAACGA TTTTTCAG | 3348 |
| 2109 | GAAAAAGU A UCCUGCUU | 429 | AAGCAGGA GGCTAGCTACAACGA ACTTTTTC | 3349 |
| 2114 | AGUAUCCU G CUUCUGAU | 2377 | ATCAGAAG GGCTAGCTACAACGA AGGATACT | 3350 |
| 2121 | UGCUUCUG A UAUGCAGU | 2866 | ACTGCATA GGCTAGCTACAACGA CAGAAGCA | 3351 |
| 2123 | CUUCUGAU A UGCAGUUU | 433 | AAACTGCA GGCTAGCTACAACGA ATCAGAAG | 3352 |
| 2125 | UCUGAUAU G CAGUUUUC | 2378 | GAAAACTG GGCTAGCTACAACGA ATATCAGA | 3353 |
| 2128 | GAUAUGCA G UUUUCCUU | 2379 | AAGGAAAA GGCTAGCTACAACGA TGCATATC | 3354 |
| 2139 | UUCCUUAA A UUAUCUAA | 2867 | TTAGATAA GGCTAGCTACAACGA TTAAGGAA | 3355 |
| 2142 | CUUAAAUU A UCUAAAAU | 441 | ATTTTAGA GGCTAGCTACAACGA AATTTAAG | 3356 |
| 2149 | UAUCUAAA A UCUGCUAG | 2868 | CTAGCAGA GGCTAGCTACAACGA TTTAGATA | 3357 |
| 2153 | UAAAAUCU G CUAGGGAA | 2380 | TTCCCTAG GGCTAGCTACAACGA AGATTTTA | 3358 |
| 2161 | GCUAGGGA A UAUCAAUA | 2869 | TATTGATA GGCTAGCTACAACGA TCCCTAGC | 3359 |
| 2163 | UAGGGAAU A UCAAUAGA | 446 | TCTATTGA GGCTAGCTACAACGA ATTCCCTA | 3360 |

TABLE XI-continued

Human PKR DNAzyme and Substrate Sequence

| Pos | Substrate | Seq ID | DNAzyme | Seq ID |
|---|---|---|---|---|
| 2167 | GAAUAUCA A UAGAUAUU | 2870 | AATATCTA GGCTAGCTACAACGA TGATATTC | 3361 |
| 2171 | AUCAAUAG A UAUUUACC | 2871 | GGTAAATA GGCTAGCTACAACGA CTATTGAT | 3362 |
| 2173 | CAAUAGAU A UUUACCUU | 449 | AAGGTAAA GGCTAGCTACAACGA ATCTATTG | 3363 |
| 2177 | AGAUAUUA A CCUUUUAU | 452 | ATAAAAGG GGCTAGCTACAACGA AAATATCT | 3364 |
| 2184 | UACCUUUU A UUUUAAUG | 456 | CATTAAAA GGCTAGCTACAACGA AAAAGGTA | 3365 |
| 2190 | UUAUUUUA A UGUUUCCU | 2872 | AGGAAACA GGCTAGCTACAACGA TAAAATAA | 3366 |
| 2192 | AUUUUAAU G UUUCCUUU | 2381 | AAAGGAAA GGCTAGCTACAACGA ATTAAAAT | 3367 |
| 2202 | UUCCUUUA A UUUUUUAC | 2873 | GTAAAAAA GGCTAGCTACAACGA TAAAGGAA | 3368 |
| 2209 | AAUUUUUU A CUAUUUUU | 472 | AAAAATAG GGCTAGCTACAACGA AAAAAATT | 3369 |
| 2212 | UUUUUACU A UUUUACUU | 473 | AGTAAAAA GGCTAGCTACAACGA AGTAAAAA | 3370 |
| 2218 | CUAUUUUU A CUAACUUU | 478 | AAGATTAG GGCTAGCTACAACGA AAAAATAG | 3371 |
| 2222 | UUUUACUA A UCUUUCUG | 2874 | CAGAAAGA GGCTAGCTACAACGA TAGTAAAA | 3372 |
| 2230 | AUCUUUCU G CAGAAACA | 2382 | TGTTTCTG GGCTAGCTACAACGA AGAAAGAT | 3373 |
| 2236 | CUGCAGAA A CAGAAAGG | 2875 | CCTTTCTG GGCTAGCTACAACGA TTCTGCAG | 3374 |
| 2244 | ACAGAAAG G UUUUCUUC | 2383 | GAAGAAAA GGCTAGCTACAACGA CTTTCTGT | 3375 |
| 2258 | UUCUUUUU G CUUCAAAA | 2384 | TTTTGAAG GGCTAGCTACAACGA AAAAAGAA | 3376 |
| 2267 | CUUCAAAA A CAUUCUUA | 2876 | TAAGAATG GGCTAGCTACAACGA TTTTGAAG | 3377 |
| 2269 | UCAAAAAC A UUCUUACA | 1636 | TGTAAGAA GGCTAGCTACAACGA GTTTTTGA | 3378 |
| 2275 | ACAUUCUU A CAUUUUAC | 499 | GTAAAATG GGCTAGCTACAACGA AAGAATGT | 3379 |
| 2277 | AUUCUUAC A UUUUACUU | 1638 | AAGTAAAA GGCTAGCTACAACGA GTAAGAAT | 3380 |
| 2282 | UACAUUUU A CUUUUUCC | 503 | GGAAAAAG GGCTAGCTACAACGA AAAATGTA | 3381 |
| 2293 | UUUUCCUG G CUCAUCUC | 2385 | GAGATGAG GGCTAGCTACAACGA CAGGAAAA | 3382 |
| 2297 | CCUGGCUC A UCUCUUUA | 1643 | TAAAGAGA GGCTAGCTACAACGA GAGCCAGG | 3383 |
| 2305 | AUCUCUUU A UUCUUUUU | 514 | AAAAAGAA GGCTAGCTACAACGA AAAGAGAT | 3384 |
| 2327 | UUUUAAAG A CAGAGUCU | 2877 | AGACTCTG GGCTAGCTACAACGA CTTTAAAA | 3385 |
| 2332 | AAGACAGA G UCUCGCUC | 2386 | GAGCGAGA GGCTAGCTACAACGA TCTGTCTT | 3386 |
| 2337 | AGAGUCUC G CUCUGUUG | 2387 | CAACAGAG GGCTAGCTACAACGA GAGACTCT | 3387 |
| 2342 | CUCGCUCU G UUGCCCAG | 2388 | CTGGGCAA GGCTAGCTACAACGA AGAGCGAG | 3388 |
| 2345 | GCUCUGUU G CCCAGGCU | 2389 | AGCCTGGG GGCTAGCTACAACGA AACAGAGC | 3389 |
| 2351 | UUGCCCAG G CUGGAGUG | 2390 | CACTCCAG GGCTAGCTACAACGA CTGGGCAA | 3390 |
| 2357 | AGGCUGGA G UGCAAUGA | 2391 | TCATTGCA GGCTAGCTACAACGA TCCAGCCT | 3391 |
| 2359 | GCUGGAGU G CAAUGACA | 2392 | TGTCATTG GGCTAGCTACAACGA ACTCCAGC | 3392 |
| 2362 | GGAGUGCA A UGACACAG | 2878 | CTGTGTCA GGCTAGCTACAACGA TGCACTCC | 3393 |
| 2365 | GUGCAAUG A CACAGUCU | 2879 | AGACTGTG GGCTAGCTACAACGA CATTGCAC | 3394 |
| 2367 | GCAAUGAC A CAGUCUUG | 1656 | CAAGACTG GGCTAGCTACAACGA GTCATTGC | 3395 |
| 2370 | AUGACACA G UCUUGGCU | 2393 | AGCCAAGA GGCTAGCTACAACGA TGTGTCAT | 3396 |
| 2376 | CAGUCUUG G CUCACUGC | 2394 | GCAGTGAG GGCTAGCTACAACGA CAAGACTG | 3397 |
| 2380 | CUUGGCUC A CUGCAACU | 1660 | AGTTGCAG GGCTAGCTACAACGA GAGCCAAG | 3398 |
| 2383 | GGCUCACU G CAACUUCU | 2395 | AGAAGTTG GGCTAGCTACAACGA AGTGAGCC | 3399 |
| 2386 | UCACUGCA A CUUCUGCC | 2880 | GGCAGAAG GGCTAGCTACAACGA TGCAGTGA | 3400 |
| 2392 | CAACUUCU G CCUCUUGG | 2396 | CCAAGAGG GGCTAGCTACAACGA AGAAGTTG | 3401 |
| 2401 | CCUCUUGG G UUCAAGUG | 2397 | CACTTGAA GGCTAGCTACAACGA CCAAGAGG | 3402 |
| 2407 | GGGUUCAA G UGAUUCUC | 2398 | GAGAATCA GGCTAGCTACAACGA TTGAACCC | 3403 |
| 2410 | UUCAAGUG A UUCUCCUG | 2881 | CAGGAGAA GGCTAGCTACAACGA CACTTGAA | 3404 |
| 2418 | AUUCUCCU G CCUCAGCC | 2399 | GGCTGAGG GGCTAGCTACAACGA AGGAGAAT | 3405 |
| 2424 | CUGCCUCA G CCUCCUGA | 2400 | TCAGGAGG GGCTAGCTACAACGA TGAGGCAG | 3406 |
| 2433 | CCUCCUGA G UAGCUGGA | 2401 | TCCAGCTA GGCTAGCTACAACGA TCAGGAGG | 3407 |
| 2436 | CCUGAGUA G CUGGAUUA | 2402 | TAATCCAG GGCTAGCTACAACGA TACTCAGG | 3408 |
| 2441 | GUAGCUGG A UUACAGGC | 2882 | GCCTGTAA GGCTAGCTACAACGA CCAGCTAC | 3409 |
| 2444 | GCUGGAUU A CAGGCAUG | 551 | CATGCCTG GGCTAGCTACAACGA AATCCAGC | 3410 |
| 2448 | GAUUACAG G CAUGUGCC | 2403 | GGCACATG GGCTAGCTACAACGA CTGTAATC | 3411 |
| 2450 | UUACAGGC A UGUGCCAC | 1681 | GTGGCACA GGCTAGCTACAACGA GCCTGTAA | 3412 |
| 2452 | ACAGGCAU G UGCCACCC | 2404 | GGGTGGCA GGCTAGCTACAACGA ATGCCTGT | 3413 |
| 2454 | AGGCAUGU G CCACCCAC | 2405 | GTGGGTGG GGCTAGCTACAACGA ACATGCCT | 3414 |
| 2457 | CAUGUGCC A CCCACCCA | 1683 | TGGGTGGG GGCTAGCTACAACGA GGCACATG | 3415 |
| 2461 | UGCCACCC A CCCAACUA | 1686 | TAGTTGGG GGCTAGCTACAACGA GGGTGGCA | 3416 |
| 2466 | CCCACCCA A CUAAUUUU | 2883 | AAAATTAG GGCTAGCTACAACGA TGGGTGGG | 3417 |
| 2470 | CCCAACUA A UUUUUGUU | 2884 | CACAAAAA GGCTAGCTACAACGA TAGTTGGG | 3418 |
| 2476 | UAAUUUUU G UGUUUUUA | 2406 | TAAAAACA GGCTAGCTACAACGA AAAAATTA | 3419 |
| 2478 | AUUUUUGU G UUUUUAAU | 2407 | ATTAAAAA GGCTAGCTACAACGA ACAAAAAT | 3420 |
| 2485 | UGUUUUUA A UAAAGACA | 2885 | TGTCTTTA GGCTAGCTACAACGA TAAAAACA | 3421 |
| 2491 | UAAUAAAG A CAGGGUUU | 2886 | AAACCCTG GGCTAGCTACAACGA CTTTATTA | 3422 |
| 2496 | AAGACAGG G UUUCACCA | 2408 | TGGTGAAA GGCTAGCTACAACGA CCTGTCTT | 3423 |
| 2501 | AGGGUUUC A CCAUGUUG | 1692 | CAACATGG GGCTAGCTACAACGA GAAACCCT | 3424 |
| 2504 | GUUUCACC A UGUUGGCC | 1694 | GGCCAACA GGCTAGCTACAACGA GGTGAAAC | 3425 |
| 2506 | UUCACCAU G UUGGCCAG | 2409 | CTGGCCAA GGCTAGCTACAACGA ATGGTGAA | 3426 |
| 2510 | CCAUGUUG G CCAGGCUG | 2410 | CAGCCTGG GGCTAGCTACAACGA CAACATGG | 3427 |
| 2515 | UUGGCCAG G CUGGUCUC | 2411 | GAGACCAG GGCTAGCTACAACGA CTGGCCAA | 3428 |
| 2519 | CCAGGCUG G UCUCAAAC | 2412 | GTTTGAGA GGCTAGCTACAACGA CAGCCTGG | 3429 |
| 2526 | GGUCUCAA A CUCCUGAC | 2887 | GTCAGGAG GGCTAGCTACAACGA TTGAGACC | 3430 |
| 2533 | AACUCCUG A CCUCAAGU | 2888 | ACTTGAGG GGCTAGCTACAACGA CAGGAGTT | 3431 |
| 2540 | GACCUCAA G UAAUCCAC | 2413 | GTGGATTA GGCTAGCTACAACGA TTGAGGTC | 3432 |
| 2543 | CUCAAGUA A UCCACCUG | 2889 | CAGGTGGA GGCTAGCTACAACGA TACTTGAG | 3433 |
| 2547 | AGUAAUCC A CCUGCCUC | 1707 | GAGGCAGG GGCTAGCTACAACGA GGATTACT | 3434 |
| 2551 | AUCCACCU G CCUCGGCC | 2414 | GGCCGAGG GGCTAGCTACAACGA AGGTGGAT | 3435 |

TABLE XI-continued

Human PKR DNAzyme and Substrate Sequence

| Pos | Substrate | Seq ID | DNAzyme | Seq ID |
|---|---|---|---|---|
| 2557 | CUGCCUCG G CCUCCCAA | 2415 | TTGGGAGG GGCTAGCTACAACGA CGAGGCAG | 3436 |
| 2567 | CUCCCAAA G UGCUGGGA | 2416 | TCCCAGCA GGCTAGCTACAACGA TTTGGGAG | 3437 |
| 2569 | CCCAAAGU G CUGGGAUU | 2417 | AATCCCAG GGCTAGCTACAACGA ACTTTGGG | 3438 |
| 2575 | GUGCUGGG A UUACAGGG | 2890 | CCCTGTAA GGCTAGCTACAACGA CCCAGCAC | 3439 |
| 2578 | CUGGGAUU A CAGGGAUG | 576 | CATCCCTG GGCTAGCTACAACGA AATCCCAG | 3440 |
| 2584 | UUACAGGG A UGAGCCAC | 2891 | GTGGCTCA GGCTAGCTACAACGA CCCTGTAA | 3441 |
| 2588 | AGGGAUGA G CCACCGCG | 2418 | CGCGGTGG GGCTAGCTACAACGA TCATCCCT | 3442 |
| 2591 | GAUGAGCC A CCGCGCCC | 1720 | GGGCGCGG GGCTAGCTACAACGA GGCTCATC | 3443 |
| 2594 | GAGCCACC G CGCCCAGC | 2419 | GCTGGGCG GGCTAGCTACAACGA GGTGGCTC | 3444 |
| 2596 | GCCACCGC G CCCAGCCU | 2420 | AGGCTGGG GGCTAGCTACAACGA GCGGTGGC | 3445 |
| 2601 | CGCGCCCA G CCUCAUCU | 2421 | AGATGAGG GGCTAGCTACAACGA TGGGCGCG | 3446 |
| 2606 | CCAGCCUC G UCUCUUUG | 1727 | CAAAGAGA GGCTAGCTACAACGA GAGGCTGG | 3447 |
| 2614 | AUCUCUUU G UUCUAAAG | 2422 | CTTTAGAA GGCTAGCTACAACGA AAAGAGAT | 3448 |
| 2623 | UUCUAAAG A UGGAAAAA | 2892 | TTTTTCCA GGCTAGCTACAACGA CTTTAGAA | 3449 |
| 2631 | AUGGAAAA A CCACCCCC | 2893 | GGGGGTGG GGCTAGCTACAACGA TTTTCCAT | 3450 |
| 2634 | GAAAAACC A CCCCCAAA | 1732 | TTTGGGGG GGCTAGCTACAACGA GGTTTTTC | 3451 |
| 2642 | ACCCCCAA A UUUUCUUU | 2894 | AAAGAAAA GGCTAGCTACAACGA TTGGGGGT | 3452 |
| 2653 | UUCUUUUU A UACUAUUA | 593 | TAATAGTA GGCTAGCTACAACGA AAAAAGAA | 3453 |
| 2655 | CUUUUUAU A CUAUUAAU | 594 | ATTAATAG GGCTAGCTACAACGA ATAAAAAG | 3454 |
| 2658 | UUUAUACU A UUAAUGAA | 595 | TTCATTAA GGCTAGCTACAACGA AGTATAAA | 3455 |
| 2662 | UACUAUUA A UGAAUCAA | 2895 | TTGATTCA GGCTAGCTACAACGA TAATAGTA | 3456 |
| 2666 | AUUAAUGA A UCAAUCAA | 2896 | TTGATTGA GGCTAGCTACAACGA TCATTAAT | 3457 |
| 2670 | AUGAAUCA A UCAAUUCA | 2897 | TGAATTGA GGCTAGCTACAACGA TGATTCAT | 3458 |
| 2674 | AUCAAUCA A UUCAUAUC | 2898 | GATATGAA GGCTAGCTACAACGA TGATTGAT | 3459 |
| 2678 | AUCAAUUC A UAUCUAUU | 1742 | AATAGATA GGCTAGCTACAACGA GAATTGAT | 3460 |
| 2680 | CAAUUCAU A UCUAUUUA | 602 | TAAATAGA GGCTAGCTACAACGA ATGAATTG | 3461 |
| 2684 | UCAUAUCU A UUUAUUAA | 604 | TTAATAAA GGCTAGCTACAACGA AGATATGA | 3462 |
| 2688 | AUCUAUUU A UUAAAUUU | 607 | AAATTTAA GGCTAGCTACAACGA AAATAGAT | 3463 |
| 2693 | UUUAUUAA A UUUCUACC | 2899 | GGTAGAAA GGCTAGCTACAACGA TTAATAAA | 3464 |
| 2699 | AAAUUUCU A CCGCUUUU | 613 | AAAAGCGG GGCTAGCTACAACGA AGAAATTT | 3465 |
| 2702 | UUUCUACC G CUUUUAGG | 2423 | CCTAAAAG GGCTAGCTACAACGA GGTAGAAA | 3466 |
| 2710 | GCUUUUAG G CCAAAAAA | 2424 | TTTTTTGG GGCTAGCTACAACGA CTAAAAGC | 3467 |
| 2719 | CCAAAAAA G UGUAAGAU | 2900 | ATCTTACA GGCTAGCTACAACGA TTTTTTGG | 3468 |
| 2721 | AAAAAAAU G UAAGAUCG | 2425 | CGATCTTA GGCTAGCTACAACGA ATTTTTTT | 3469 |
| 2726 | AAUGUAAG A UCGUUCUC | 2901 | GAGAACGA GGCTAGCTACAACGA CTTACATT | 3470 |
| 2729 | GUAAGAUC G UUCUCUGC | 2426 | GCAGAGAA GGCTAGCTACAACGA GATCTTAC | 3471 |
| 2736 | CGUUCUCU G CCUCACAU | 2427 | ATGTGAGG GGCTAGCTACAACGA AGAGAACG | 3472 |
| 2741 | UCUGCCUC A CAUAGCUU | 1753 | AAGCTATG GGCTAGCTACAACGA GAGGCAGA | 3473 |
| 2743 | UGCCUCAC A UAGCUUAC | 1754 | GTAAGCTA GGCTAGCTACAACGA GTGAGGCA | 3474 |
| 2746 | CUCACAUA G CUUACAAG | 2428 | CTTGTAAG GGCTAGCTACAACGA TATGTGAG | 3475 |
| 2750 | CAUAGCUU A CAAGCCAG | 626 | CTGGCTTG GGCTAGCTACAACGA AAGCTATG | 3476 |
| 2754 | GCUUACAA G CCAGCUGG | 2429 | CCAGCTGG GGCTAGCTACAACGA TTGTAAGC | 3477 |
| 2758 | ACAAGCCA G CUGGAGAA | 2430 | TTCTCCAG GGCTAGCTACAACGA TGGCTTGT | 3478 |
| 2767 | CUGGAGAA A UAUGGUAC | 2902 | GTACCATA GGCTAGCTACAACGA TTCTCCAG | 3479 |
| 2769 | GGAGAAAU A UGGUACUC | 627 | GAGTACCA GGCTAGCTACAACGA ATTTCTCC | 3480 |
| 2772 | GAAAUAUG G UACUCAUU | 2431 | AATGAGTA GGCTAGCTACAACGA CATATTTC | 3481 |
| 2774 | AAUAUGGU A CUCAUUAA | 628 | TTAATGAG GGCTAGCTACAACGA ACCATATT | 3482 |
| 2778 | UGGUACUC A UUAAAAAA | 1761 | TTTTTTAA GGCTAGCTACAACGA GAGTACCA | 3483 |
| 2796 | AAAAAAAA G UGAUGUAC | 2432 | GTACATCA GGCTAGCTACAACGA TTTTTTTT | 3484 |
| 2799 | AAAAAGUG A UGUACAAC | 2903 | GTTGTACA GGCTAGCTACAACGA CACTTTTT | 3485 |

Input Sequence = NM_002759. Cut Site = R/Y
Arm Length = 8. Core Sequence = GGCTAGCTACAACGA NM_002759 (*Homo sapiens* protein kinase, interferon-inducible double stranded RNA dependent (PRKR), mRNA.; 2808 bp)

TABLE XII

Human PKR Amberzyme and Substrate Sequence

| Pos | Substrate | Seq ID | Amberzyme | Seq ID |
|---|---|---|---|---|
| 9 | GCGGCGGC G GCGGCGCA | 3486 | UGCGCCGC GGAGGAAACUCC CU UCAAGGACAUCGUCCGGG GCCGCCGC | 53814 |
| 10 | CGGCGGCG G CGGCGCAG | 2261 | CUGCGCCG GGAGGAAACUCC CU UCAAGGACAUCGUCCGGG CGCCGCCG | 3815 |
| 12 | GCGGCGGC G GCGCAGUU | 3487 | AACUGCGC GGAGGAAACUCC CU UCAAGGACAUCGUCCGGG GCCGCCGC | 3816 |
| 13 | CGGCGGCG G CGCAGUUU | 2433 | AAACUGCG GGAGGAAACUCC CU UCAAGGACAUCGUCCGGG CGCCGCCG | 3817 |
| 15 | GCGGCGGC G CAGUUUGC | 2434 | GCAAACUG GGAGGAAACUCC CU UCAAGGACAUCGUCCGGG GCCGCCGC | 3818 |
| 18 | GCGGCGCA G UUUGCUCA | 2435 | UGAGCAAA GGAGGAAACUCC CU UCAAGGACAUCGUCCGGG UGCGCCGC | 3819 |
| 22 | CGCAGUUU G CUCAUACU | 2436 | AGUAUGAG GGAGGAAACUCC CU UCAAGGACAUCGUCCGGG AAACUGCG | 3820 |
| 33 | CAUACUUU G UGACUUGC | 2437 | GCAAGUCA GGAGGAAACUCC CU UCAAGGACAUCGUCCGGG AAAGUAUG | 3821 |
| 35 | UACUUUCU G ACUUGCGG | 3488 | CCGCAAGU GGAGGAAACUCC CU UCAAGGACAUCGUCCGGG ACAAAGUA | 3822 |
| 40 | UGUGACUU G CGCUCACA | 2438 | UCUCACCG GGAGGAAACUCC CU UCAAGGACAUCGUCCGGG AAGUCACA | 3823 |
| 42 | UGACUUGC G GUCACAGU | 3489 | ACUGUGAC GGAGGAAACUCC CU UCAAGGACAUCGUCCGGG GCAAGUCA | 3824 |
| 43 | GACUUGCG G UCACAGUG | 2439 | CACUGUGA GGAGGAAACUCC CU UCAAGGACAUCGUCCGGG CGCAAGUC | 3825 |

TABLE XII-continued

Human PKR Amberzyme and Substrate Sequence

| Pos | Substrate | Seq ID | Amberzyme | Seq ID |
|---|---|---|---|---|
| 49 | CGGUCACA G UGGCAUUC | 2440 | GAAUGCCA GGAGGAAACUCC CU UCAAGGACAUCGUCCGGG UGUCACCG | 3826 |
| 51 | GUCACAGU G GCAUUCAG | 3490 | CUGAAUGC GGAGGAAACUCC CU UCAAGGACAUCGUCCGGG ACUGUGAC | 3827 |
| 52 | UCACAGUG G CAUUCAGC | 2441 | GCUGAAUG GGAGGAAACUCC CU UCAAGGACAUCGUCCGGG CACUGUGA | 3828 |
| 59 | GGCAUUCA G CUCCACAC | 2442 | GUGUGGAG GGAGGAAACUCC CU UCAAGGACAUCGUCCGGG UGAAUGCC | 3829 |
| 70 | CCACACUU G GUAGAACC | 3491 | GGUUCUAC GGAGGAAACUCC CU UCAAGGACAUCGUCCGGG AAGUGUGG | 3830 |
| 71 | CACACUUG G UAGAACCA | 2443 | UGGUUCUA CGAGGAAACUCC CU UCAAGGACAUCGUCCGGG CAAGUGUG | 3831 |
| 74 | ACUUGGUA G AACCACAG | 3492 | CUGUGGUU GGAGGAAACUCC CU UCAAGGACAUCGUCCGGG UACCAAGU | 3832 |
| 82 | GAACCACA G GCACGACA | 3493 | UGUCGUGC GGAGGAAACUCC CU UCAAGGACAUCGUCCGGG UGUGGUUC | 3833 |
| 83 | AACCACAG G CACGACAA | 2444 | UUGUCGUG GGAGGAAACUCC CU UCAAGGACAUCGUCCGGG CUGUGGUU | 3834 |
| 87 | ACAGGCAC G ACAAGCAU | 3494 | AUGCUUGU GGAGGAAACUCC CU UCAAGGACAUCGUCCGGG GUGCCUGU | 3835 |
| 92 | CACGACAA G CAUAGAAA | 2445 | UUUCUAUG GGAGGAAACUCC CU UCAAGGACAUCGUCCGGG UUGUCGUG | 3836 |
| 97 | CAACCAUA G AAACAUCC | 3495 | GGAUGUUU GGAGGAAACUCC CU UCAAGGACAUCGUCCGGG UAUGCUUG | 3837 |
| 121 | UCUUCAUC G AGGCAUCG | 3496 | CGAUGCCU GGAGGAAACUCC CU UCAAGGACAUCGUCCGGG GAUGAAGA | 3838 |
| 123 | UUCAUCCA G CAUCGAG | 3497 | CUCGAUGC GGAGGAAACUCC CU UCAAGGACAUCGUCCGGG UCGAUGAA | 3839 |
| 124 | UCAUCCAC G CAUCCAGG | 2446 | CCUCGAUG GGAGGAAACUCC CU UCAAGGACAUCGUCCGGG CUCGAUGA | 3840 |
| 129 | GAGGCAUC G AGGCCAU | 3498 | AUGGACCU GGAGGAAACUCC CU UCAAGGACAUCGUCCGGG GAUGCCUC | 3841 |
| 131 | GGCAUCGA G GUCCAUCC | 3499 | GGAUGGAC GGAGGAAACUCC CU UCAAGGACAUCGUCCGGG UCGAUGCC | 3842 |
| 132 | GCAUCGAC G UCCAUCCC | 2447 | GGGAUGGA GGAGGAAACUCC CU UCAAGGACAUCGUCCGGG CUCGAUGC | 3843 |
| 152 | AAAAAUCA G GAGACCCU | 3500 | AGGGUCUC GGAGGAAACUCC CU UCAAGGACAUCGUCCGGG UCAUUUUU | 3844 |
| 153 | AAAAAUCAG G AGACCUG | 3501 | CAGGGUCU GGAGGAAACUCC CU UCAAGGACAUCGUCCGGG CUGAUUUU | 3845 |
| 155 | AAUCAGGA G ACCCUGGC | 3502 | GCCAGGGU GGAGGAAACUCC CU UCAAGGACAUCGUCCGGG UCCUGAUU | 3846 |
| 161 | GAGACCCU G CUAUCAU | 3503 | AUGAUAGC GGAGGAAACUCC CU UCAAGGACAUCGUCCGGG AGGGUCUC | 3847 |
| 162 | ACACCCUG G CUAUCAUA | 2448 | UAUGAUAG GGAGGAAACUCC CU UCAAGGACAUCGUCCGGG CAGGGUCU | 3848 |
| 171 | CUAUCAUA G ACCUUAGU | 3504 | ACUAAGGU GGAGGAAACUCC CU UCAAGGACAUCGUCCGGG UAUGAUAG | 3849 |
| 178 | AGACCUUA G UCUUCGCU | 2449 | AGCGAAGA GGAGGAAACUCC CU UCAAGGACAUCGUCCGGG UAAGGUCU | 3850 |
| 184 | UAGUCUUC G CUGGUAUA | 2450 | UAUACCAG GGAGGAAACUCC CU UCAAGGACAUCGUCCGGG GAAGACUA | 3851 |
| 187 | UCUUCGCU G GUAUACUC | 3505 | GAGUAUAC GGAGGAAACUCC CU UCAAGGACAUCGUCCGGG AGCGAAGA | 3852 |
| 188 | CUUCGCUG G UAUACUCG | 2451 | CGAGUAUA GGAGGAAACUCC CU UCAAGGACAUCGUCCGGG CAGCGAAG | 3853 |
| 196 | GUAUACUC G CUGUCUGU | 2452 | ACAGACAG GGAGGAAACUCC CU UCAAGGACAUCGUCCGGG GAGUAUAC | 3854 |
| 199 | UACUCGCU G UCUGUCAA | 2453 | UUGACAGA GGAGGAAACUCC CU UCAAGGACAUCGUCCGGG AGCGAGUA | 3855 |
| 203 | CGCUGUCU G UCAACCAG | 2454 | CUGGUUGA GGAGGAAACUCC CU UCAAGGACAUCGUCCGGG AGACAGCG | 3856 |
| 211 | GUCAACCA G CGGUUGAC | 2455 | GUCAACCG GGAGGAAACUCC CU UCAAGGACAUCGUCCGGG UGGUUGAC | 3857 |
| 213 | CAACCAGC G GUUGACUU | 3506 | AAGUCAAC GGAGGAAACUCC CU UCAAGGACAUCGUCCGGG GCUGGUUG | 3858 |
| 214 | AACCAGCG G UUGACUUU | 2456 | AAAGUCAA GGAGGAAACUCC CU UCAAGGACAUCGUCCGGG CGCUGGUU | 3859 |
| 217 | CAGCGGUU G ACUUUUUU | 3507 | AAAAAAGU GGAGGAAACUCC CU UCAAGGACAUCGUCCGGG AACCGCUG | 3860 |
| 229 | UUUUUUAA G CCUUCUUU | 2457 | AAAGAAGG GGAGGAAACUCC CU UCAAGGACAUCGUCCGGG UUAAAAAA | 3861 |
| 252 | UUUUACCA G UUUCUGGA | 2458 | UCCAGAAA GGAGGAAACUCC CU UCAAGGACAUCGUCCGGG UGGUAAAA | 3862 |
| 258 | CAGUUUCU G GAGCAAAU | 3508 | AUUUGCUC GGAGGAAACUCC CU UCAAGGACAUCGUCCGGG AGAAACUG | 3863 |
| 259 | AGUUUCUG G AGCAAAUU | 3509 | AAUUUGCU GGAGGAAACUCC CU UCAAGGACAUCGUCCGGG CAGAAACU | 3864 |
| 261 | UUUCUGGA G CAAAUUCA | 2459 | UGAAUUUG GGAGGAAACUCC CU UCAAGGACAUCGUCCGGG UCCAGAAA | 3865 |
| 270 | CAAAUUCA G UUUGCCUU | 2460 | AAGGCAAA GGAGGAAACUCC CU UCAAGGACAUCGUCCGGG UGAAUUUG | 3866 |
| 274 | UUCAGUUU G CCUUCCUG | 2461 | CAGGAAGG GGAGGAAACUCC CU UCAAGGACAUCGUCCGGG AAACUGAA | 3867 |
| 282 | GCCUUCCU G GAUUGUA | 3510 | UACAAAUC GGAGGAAACUCC CU UCAAGGACAUCGUCCGGG AGGAAGGC | 3868 |
| 283 | CCUUCCUG G AUUUGUAA | 3511 | UUACAAAU GGAGGAAACUCC CU UCAAGGACAUCGUCCGGG CAGGAAGG | 3869 |
| 288 | CUGGAUUU G UAAAUUGU | 2462 | ACAAUUUA GGAGGAAACUCC CU UCAAGGACAUCGUCCGGG AAAUCCAG | 3870 |
| 295 | UCUAAAUU G UAAUGACC | 2463 | GGUCAUUA GGAGGAAACUCC CU UCAAGGACAUCGUCCGGG AAUUUACA | 3871 |
| 300 | AUUGUAAU G ACCUCAAA | 3512 | UUUGAGGU GGAGGAAACUCC CU UCAAGGACAUCGUCCGGG AUUACAAU | 3872 |
| 315 | AAACUUUA G CAGUUCUU | 2464 | AAGAACUG GGAGGAAACUCC CU UCAAGGACAUCGUCCGGG UAAAGUUU | 3873 |
| 318 | CUUUAGCA G UUCUUCCA | 2465 | UGGAAGAA GGAGGAAACUCC CU UCAAGGACAUCGUCCGGG UGCUAAAC | 3874 |
| 330 | UUCCAUCU G ACUCAGGU | 3513 | ACCUGAGU GGAGGAAACUCC CU UCAAGGACAUCGUCCGGG AGAUGGAA | 3875 |
| 336 | CUGACUCA G UUUGCUU | 3514 | AAGCAAAC GGAGGAAACUCC CU UCAAGGACAUCGUCCGGG UGAGUCAG | 3876 |
| 337 | UGACUCAG G UUUGCUUC | 2466 | GAAGCAAA GGAGGAAACUCC CU UCAAGGACAUCGUCCGGG CUGAGUCA | 3877 |
| 341 | UCAGGUUU G CUUCUCUG | 2467 | CAGAGAAG GGAGGAAACUCC CU UCAAGGACAUCGUCCGGG AAACCUGA | 3878 |
| 349 | GCUUCUCU G CGGUCUUC | 3515 | AAGACCGC GGAGGAAACUCC CU UCAAGGACAUCGUCCGGG AGAGAAGC | 3879 |
| 350 | CUUCUCUG G CGGUCUUC | 2468 | GAAGACCG GGAGGAAACUCC CU UCAAGGACAUCGUCCGGG CAGAGAAG | 3880 |
| 352 | UCUCUGGC G GUCUUCAG | 3516 | CUGAAGAC GGAGGAAACUCC CU UCAAGGACAUCGUCCGGG GCCAGAGA | 3881 |
| 353 | CUCUGGCG G UCUUCAGA | 2469 | UCUGAAGA GGAGGAAACUCC CU UCAAGGACAUCGUCCGGG CGCCAGAC | 3882 |
| 360 | CGUCUUCA G AAUCAACA | 3517 | UGUUGAUU GGAGGAAACUCC CU UCAAGGACAUCGUCCGGG UGAAGACC | 3883 |
| 380 | ACACUUCC G UGAUUAUC | 2470 | GAUAAUCA GGAGGAAACUCC CU UCAAGGACAUCGUCCGGG GGAAGUGU | 3884 |
| 382 | ACUUCCGU G AUUAUCUG | 3518 | CAGAUAAU GGAGGAAACUCC CU UCAAGGACAUCGUCCGGG ACGGAAGU | 3885 |
| 390 | GAUUAUCU G CGUGCAUU | 2471 | AAUGCACG GGAGGAAACUCC CU UCAAGGACAUCGUCCGGG AGAUAAUC | 3886 |
| 392 | UUAUCUGC G UGCAUUU | 2472 | AAAAUGCA GGAGGAAACUCC CU UCAAGGACAUCGUCCGGG GCAGAUAA | 3887 |
| 394 | AUCUGCGU G CAUUUUGG | 2473 | CCAAAAUG GGAGGAAACUCC CU UCAAGGACAUCGUCCGGG ACGCAGAU | 3888 |
| 401 | UGCAUUUU G GACAAAGC | 3519 | GCUUUGUC GGAGGAAACUCC CU UCAAGGACAUCGUCCGGG AAAAUGCA | 3889 |
| 402 | GCAUUUUG G ACAAAGCU | 3520 | AGCUUUGU GGAGGAAACUCC CU UCAAGGACAUCGUCCGGG CAAAAUGC | 3890 |
| 408 | UGGACAAA G CUUCCAAC | 2474 | GUUGGAAG GGAGGAAACUCC CU UCAAGGACAUCGUCCGGG UUUGUCCA | 3891 |
| 419 | UCCAACCA G AUACGGGA | 3521 | CCCGUAUC GGAGGAAACUCC CU UCAAGGACAUCGUCCGGG UGGUUGGA | 3892 |
| 420 | CCAACCAG G AUACGGGA | 3522 | UCCCGUAU GGAGGAAACUCC CU UCAAGGACAUCGUCCGGG CUGGUUGG | 3893 |
| 425 | CAGGAUAC G GAAGAAG | 3523 | CUUCUUCC GGAGGAAACUCC CU UCAAGGACAUCGUCCGGG GUAUCCUG | 3894 |
| 426 | AGGAUACG G AAGAAGAA | 3524 | UCUUCUUC GGAGGAAACUCC CU UCAAGGACAUCGUCCGGG CGUAUCCU | 3895 |
| 427 | GGAUACGG A AGAAGAA | 3525 | UUCUUCUU GGAGGAAACUCC CU UCAAGGACAUCGUCCGGG CCGUAUCC | 3896 |
| 430 | UACGGGAA G AAGAAAUG | 3526 | CAUUUCUU GGAGGAAACUCC CU UCAAGGACAUCGUCCGGG UUCCCGUA | 3897 |
| 433 | GGGAAGAA G AAAUGGCU | 3527 | AGCCAUUU GGAGGAAACUCC CU UCAAGGACAUCGUCCGGG UUCUUCCC | 3898 |
| 438 | GAAGAAAU G GCUGGUGA | 3528 | UCACCAGC GGAGGAAACUCC CU UCAAGGACAUCGUCCGGG AUUUCUUC | 3899 |
| 439 | AAGAAAUG G CUGGUGAU | 2475 | AUCACCAG GGAGGAAACUCC CU UCAAGGACAUCGUCCGGG CAUUUCUU | 3900 |

TABLE XII-continued

Human PKR Amberzyme and Substrate Sequence

| Pos | Substrate | | | Seq ID | Amberzyme | | | Seq ID |
|---|---|---|---|---|---|---|---|---|
| 442 | AAAUGGCU | G | GUGAUCUU | 3529 | AAGAUCAC GGAGGAAACUCC CU UCAAGGACAUCGUCCGGG AGCCAUUU | | | 3901 |
| 443 | AAUGGCUG | G | UGAUCUUU | 2476 | AAAGAUCA GGAGGAAACUCC CU UCAAGGACAUCGUCCGGG CAGCCAUU | | | 3902 |
| 445 | UGGCUGGU | G | AUCUUUCA | 3530 | UGAAAGAU GGAGGAAACUCC CU UCAAGGACAUCGUCCGGG ACCAGCCA | | | 3903 |
| 454 | AUCUUUCA | G | CAGGUUUC | 2477 | GAAACCUG GGAGGAAACUCC CU UCAAGGACAUCGUCCGGG UGAAAGAU | | | 3904 |
| 457 | UUUCAGCA | G | GUUUCUUC | 3531 | GAAGAAAC GGAGGAAACUCC CU UCAAGGACAUCGUCCGGG UGCUGAAA | | | 3905 |
| 458 | UUCAGCAG | G | UUUCUUCA | 2478 | UGAAGAAA GGAGGAAACUCC CU UCAAGGACAUCGUCCGGG CUGCUGAA | | | 3906 |
| 468 | UUCUUCAU | G | GAGGAACU | 3532 | AGUUCCUC GGAGGAAACUCC CU UCAAGGACAUCGUCCGGG AUGAAGAA | | | 3907 |
| 469 | UCUUCAUG | G | AGGAACUU | 3533 | AAGUUCCU GGAGGAAACUCC CU UCAAGGACAUCGUCCGGG CAUGAAGA | | | 3908 |
| 471 | UUCAUGGA | G | GAACUUAA | 3534 | UUAAGUUC GGAGGAAACUCC CU UCAAGGACAUCGUCCGGG UCCAUGAA | | | 3909 |
| 472 | UCAUGGAG | G | AACUUAAU | 3535 | AUUAAGUU GGAGGAAACUCC CU UCAAGGACAUCGUCCGGG CUCCAUGA | | | 3910 |
| 488 | UACAUACC | G | UCAGAAGC | 2479 | GCUUCUGA GGAGGAAACUCC CU UCAAGGACAUCGUCCGGG GGUAUGUA | | | 3911 |
| 492 | UACCGUCA | G | AAGCAGGG | 3536 | CCCUGCUU GGAGGAAACUCC CU UCAAGGACAUCGUCCGGG UGACGGUA | | | 3912 |
| 495 | CGUCAGAA | G | CAGGGAGU | 2262 | ACUCCCUG GGAGGAAACUCC CU UCAAGGACAUCGUCCGGG UUCUGACG | | | 3913 |
| 498 | CAGAAGCA | G | GGAGUAGU | 3537 | ACUACUCC GGAGGAAACUCC CU UCAAGGACAUCGUCCGGG UGCUUCUG | | | 3914 |
| 499 | AGAAGCAG | G | GAGUAGUA | 3538 | UACUACUC GGAGGAAACUCC CU UCAAGGACAUCGUCCGGG CUGCUUCU | | | 3915 |
| 500 | GAAGCAGG | G | AGUAGUAC | 3539 | GUACUACU GGAGGAAACUCC CU UCAAGGACAUCGUCCGGG CCUGCUUC | | | 3916 |
| 502 | AGCAGGGA | G | UAGUACUU | 2263 | AAGUACUA GGAGGAAACUCC CU UCAAGGACAUCGUCCGGG UCCCUGCU | | | 3917 |
| 505 | AGGGAGUA | G | UACUUAAA | 2264 | UUUAAGUA GGAGGAAACUCC CU UCAAGGACAUCGUCCGGG UACUCCCU | | | 3918 |
| 520 | AAUAUCAA | G | AACUGCCU | 3540 | AGGCAGUU GGAGGAAACUCC CU UCAAGGACAUCGUCCGGG UUGAUAUU | | | 3919 |
| 525 | CAAGAACU | G | CCUAAUUC | 2265 | GAAUUAGG GGAGGAAACUCC CU UCAAGGACAUCGUCCGGG AGUUCUUG | | | 3920 |
| 535 | CUAAUUCA | G | GACCUCCA | 3541 | UGGAGGUC GGAGGAAACUCC CU UCAAGGACAUCGUCCGGG UGAAUUAG | | | 3921 |
| 536 | UAAUUCAG | G | ACCUCCAC | 3542 | GUGGAGGU GGAGGAAACUCC CU UCAAGGACAUCGUCCGGG CUGAAUUA | | | 3922 |
| 547 | CUCCACAU | G | UAGGAGG | 3543 | CCUCCUAU GGAGGAAACUCC CU UCAAGGACAUCGUCCGGG AUGUGGAG | | | 3923 |
| 551 | ACAUGAUA | G | GAGGUUUA | 3544 | UAAACCUC GGAGGAAACUCC CU UCAAGGACAUCGUCCGGG UAUCAUGU | | | 3924 |
| 552 | CAUGAUAG | G | AGGUUUAA | 3545 | GUAAACCU GGAGGAAACUCC CU UCAAGGACAUCGUCCGGG CUAUCAUG | | | 3925 |
| 554 | UGAUAGGA | G | GUUUACAU | 3546 | AUGUAAAC GGAGGAAACUCC CU UCAAGGACAUCGUCCGGG UCCUAUCA | | | 3926 |
| 555 | GAUAGGAG | G | UUUACAUU | 2266 | AAUGUAAA GGAGGAAACUCC CU UCAAGGACAUCGUCCGGG CUCCUAUC | | | 3927 |
| 568 | CAUUUCAA | G | UUAUAAUA | 2267 | UAUUAUAA GGAGGAAACUCC CU UCAAGGACAUCGUCCGGG UUGAAAUG | | | 3928 |
| 577 | UUAUAAUA | G | AUGGAACA | 3547 | UCUUCCAU GGAGGAAACUCC CU UCAAGGACAUCGUCCGGG UAUUAUAA | | | 3929 |
| 580 | UAAUAGAU | G | GAAGAGAA | 3548 | UUCUCUUC GGAGGAAACUCC CU UCAAGGACAUCGUCCGGG AUCUAUUA | | | 3930 |
| 581 | AAUAGAUG | G | AAGAGAAU | 3549 | AUUCUCUU GGAGGAAACUCC CU UCAAGGACAUCGUCCGGG CAUCUAUU | | | 3931 |
| 584 | AGAUGGAA | G | AGAAUUUC | 3550 | GAAAUUCU GGAGGAAACUCC CU UCAAGGACAUCGUCCGGG UUCCAUCU | | | 3932 |
| 586 | AUGGAAGA | G | AAUUUCCA | 3551 | UGGAAAUU GGAGGAAACUCC CU UCAAGGACAUCGUCCGGG UCUUCCAU | | | 3933 |
| 595 | AAUUUCCA | G | AAGGUGAA | 3552 | UUCACCUU GGAGGAAACUCC CU UCAAGGACAUCGUCCGGG UGGAAAUU | | | 3934 |
| 598 | UUCCAGAA | G | GUGAAGGU | 3553 | ACCUUCAC GGAGGAAACUCC CU UCAAGGACAUCGUCCGGG UUCUGGAA | | | 3935 |
| 599 | UCCAGAAG | G | UGAAGGUA | 2268 | UACCUUCA GGAGGAAACUCC CU UCAAGGACAUCGUCCGGG CUUCUGGA | | | 3936 |
| 601 | CAGAAGGU | G | AAGGUAGA | 3554 | UCUACCUU GGAGGAAACUCC CU UCAAGGACAUCGUCCGGG ACCUUCUG | | | 3937 |
| 604 | AAGGUGAA | G | GUAGAUCA | 3555 | UGAUCUAC GGAGGAAACUCC CU UCAAGGACAUCGUCCGGG UUCACCUU | | | 3938 |
| 605 | AGGUGAAG | G | UAGAUCAA | 2269 | UUGAUCUA GGAGGAAACUCC CU UCAAGGACAUCGUCCGGG CUUCACCU | | | 3939 |
| 608 | UGAAGGUA | G | AUCAAAGA | 3556 | UCUUUGAU GGAGGAAACUCC CU UCAAGGACAUCGUCCGGG UACCUUCA | | | 3940 |
| 615 | AGAUCAAA | G | AAGGAAGC | 3557 | GCUUCCUU GGAGGAAACUCC CU UCAAGGACAUCGUCCGGG UUUGAUCU | | | 3941 |
| 618 | UCAAAGAA | G | GAAGCAAA | 3558 | UUUGCUUC GGAGGAAACUCC CU UCAAGGACAUCGUCCGGG UUCUUUGA | | | 3942 |
| 619 | CAAAGAAG | G | AAGCAAAA | 3559 | UUUUGCUU GGAGGAAACUCC CU UCAAGGACAUCGUCCGGG CUUCUUUG | | | 3943 |
| 622 | ACAAGGAA | G | CAAAAAAU | 2270 | AUUUUUUG GGAGGAAACUCC CU UCAAGGACAUCGUCCGGG UUCCUUCU | | | 3944 |
| 631 | CAAAAAAU | G | CCGCAGCC | 2271 | GGCUGCGG GGAGGAAACUCC CU UCAAGGACAUCGUCCGGG AUUUUUUG | | | 3945 |
| 634 | AAAAUGCC | G | CAGCCAAA | 2272 | UUUGGCUC GGAGGAAACUCC CU UCAAGGACAUCGUCCGGG GGCAUUUU | | | 3946 |
| 637 | AUGCCGCA | G | CCAAAUUA | 2273 | UAAUUUGG GGAGGAAACUCC CU UCAAGGACAUCGUCCGGG UGCGGCAU | | | 3947 |
| 646 | CCAAAUUA | G | CUGUUGAG | 2274 | CUCAACAG GGAGGAAACUCC CU UCAAGGACAUCGUCCGGG UAAUUUGG | | | 3948 |
| 649 | AAUUAGCU | G | UUGAGAUA | 2275 | UAUCUCAA GGAGGAAACUCC CU UCAAGGACAUCGUCCGGG AGCUAAUU | | | 3949 |
| 652 | UAGCUGUU | G | AGAUACUU | 3560 | AAGUAUCU GGAGGAAACUCC CU UCAAGGACAUCGUCCGGG AACAGCUA | | | 3950 |
| 654 | GCUGUUCA | G | AUACUUAA | 3561 | UUAAGUAU GGAGGAAACUCC CU UCAAGGACAUCGUCCGGG UCAACAGC | | | 3951 |
| 666 | CUUAAUAA | G | GAAAACAA | 3562 | UUGUUUUC GGAGGAAACUCC CU UCAAGGACAUCGUCCGGG UUAUUAAG | | | 3952 |
| 667 | UUAAUAAG | G | AAAAGAAG | 3563 | CUUCUUUU GGAGGAAACUCC CU UCAAGGACAUCGUCCGGG CUUAUUAA | | | 3953 |
| 672 | AAGGAAAA | G | AAGGCAGU | 3564 | ACUGCCUU GGAGGAAACUCC CU UCAAGGACAUCGUCCGGG UUUUCCUU | | | 3954 |
| 675 | GAAAACAA | G | GCAGUUAG | 3565 | CUAACUGC GGAGGAAACUCC CU UCAAGGACAUCGUCCGGG UUCUUUUC | | | 3955 |
| 676 | AAAAGAAG | G | CAGUUAGU | 2276 | ACUAACUG GGAGGAAACUCC CU UCAAGGACAUCGUCCGGG CUUCUUUU | | | 3956 |
| 679 | AGAAGGCA | G | UUAGUCCU | 2277 | AGGACUAA GGAGGAAACUCC CU UCAAGGACAUCGUCCGGG UGCCUUCU | | | 3957 |
| 683 | GGCAGUUA | G | UCCUUGAU | 2278 | AUAAAGGA GGAGGAAACUCC CU UCAAGGACAUCGUCCGGG UAACUGCC | | | 3958 |
| 696 | UUAUUAUU | G | ACAACAAC | 3566 | GUUGUUGU GGAGGAAACUCC CU UCAAGGACAUCGUCCGGG AAUAAUAA | | | 3959 |
| 705 | ACAACAAC | G | AAUUCUUC | 3567 | GAAGAAUU GGAGGAAACUCC CU UCAAGGACAUCGUCCGGG GUUGUUGU | | | 3960 |
| 715 | AUUCUUCA | G | AAGGAUUA | 3568 | UAACCUU GGAGGAAACUCC CU UCAAGGACAUCGUCCGGG UGAAGAAU | | | 3961 |
| 718 | CUUCAGAA | G | GAUUAUCC | 3569 | GGAUAAUC GGAGGAAACUCC CU UCAAGGACAUCGUCCGGG UUCUGAAG | | | 3962 |
| 719 | UUCAGAAG | G | AUUAUCCA | 3570 | UGGAUAAU GGAGGAAACUCC CU UCAAGGACAUCGUCCGGG CUUCUGAA | | | 3963 |
| 729 | UUAUCCAU | G | GGAAUUAC | 3571 | UAAUUCCC GGAGGAAACUCC CU UCAAGGACAUCGUCCGGG AUGGAUAA | | | 3964 |
| 730 | UAUCCAUG | G | GAAUUACU | 3572 | GUAAUUCC GGAGGAAACUCC CU UCAAGGACAUCGUCCGGG CAUGGAUA | | | 3965 |
| 731 | AUCCAUGG | G | AAUUACAC | 3573 | UGUAAUUC GGAGGAAACUCC CU UCAAGGACAUCGUCCGGG CCAUGGAU | | | 3966 |
| 732 | UCCAUGGG | G | AAUUACAU | 3574 | AUGUAAUU GGAGGAAACUCC CU UCAAGGACAUCGUCCGGG CCCAUGGA | | | 3967 |
| 742 | AUUACAUA | G | CCUUAUCA | 3575 | GAUAAGGC GGAGGAAACUCC CU UCAAGGACAUCGUCCGGG UAUGUAAU | | | 3968 |
| 743 | UUACAUAG | G | CCUUAUCA | 2279 | UGAUAAGG GGAGGAAACUCC CU UCAAGGACAUCGUCCGGG CUAUGUAA | | | 3969 |
| 755 | UACACAUA | G | AAUUGCCC | 3576 | GGGCAAUU GGAGGAAACUCC CU UCAAGGACAUCGUCCGGG UAUUGUAA | | | 3970 |
| 760 | AUAGAAUU | G | CCCAGAAG | 2280 | CUUCUGGG GGAGGAAACUCC CU UCAAGGACAUCGUCCGGG AAUUCUAU | | | 3971 |
| 765 | AUUGCCCA | G | AAGAAAAG | 3577 | CUUUUCUU GGAGGAAACUCC CU UCAAGGACAUCGUCCGGG UGGGCAAU | | | 3972 |
| 768 | GCCCAGAA | G | AAAAGACU | 3578 | AGUCUUUU GGAGGAAACUCC CU UCAAGGACAUCGUCCGGG UUCUGGGC | | | 3973 |
| 773 | GAAGAAAA | G | ACUAACUG | 3579 | CAGUUAGU GGAGGAAACUCC CU UCAAGGACAUCGUCCGGG UUUUCUUC | | | 3974 |
| 781 | GACUAACU | G | UAAAUUAU | 2281 | AUAAUUUA GGAGGAAACUCC CU UCAAGGACAUCGUCCGGG AGUUAGUC | | | 3975 |

TABLE XII-continued

Human PKR Amberzyme and Substrate Sequence

| Pos | Substrate | Seq ID | Amberzyme | Seq ID |
|---|---|---|---|---|
| 790 | UAAAUUAU G AACAGUGU | 3580 | ACACUGUU GGAGGAAACUCC CU UCAAGGACAUCGUCCGGG AUAAUUUA | 3976 |
| 795 | UAUGAACA G UGUGCAUC | 2282 | GAUGCACA GGAGGAAACUCC CU UCAAGGACAUCGUCCGGG UGUUCAUA | 3977 |
| 797 | UGAACAGU G UGCAUCGG | 2283 | CCGAUGCA GGAGGAAACUCC CU UCAAGGACAUCGUCCGGG ACUGUUCA | 3978 |
| 799 | AACAGUGU G CAUCGGGG | 2284 | CCCCGAUG GGAGGAAACUCC CU UCAAGGACAUCGUCCGGG ACACUGUU | 3979 |
| 804 | UGUGCAUC G GGGUGCA | 3581 | UGCACCCC GGAGGAAACUCC CU UCAAGGACAUCGUCCGGG GAUGCACA | 3980 |
| 805 | GUGCAUCG G GGUGCAU | 3582 | AUGCACCC GGAGGAAACUCC CU UCAAGGACAUCGUCCGGG CGAUGCAC | 3981 |
| 806 | UGCAUCGG G GGUGCAUG | 3583 | CAUGCACC GGAGGAAACUCC CU UCAAGGACAUCGUCCGGG CCGAUGCA | 3982 |
| 807 | GCAUCGGG G GUGCAUGG | 3584 | CCAUGCAC GGAGGAAACUCC CU UCAAGGACAUCGUCCGGG CCCGAUGC | 3983 |
| 808 | CAUCGGGG G UGCAUGGG | 2285 | CCCAUGCA GGAGGAAACUCC CU UCAAGGACAUCGUCCGGG CCCCGAUG | 3984 |
| 810 | UCGGGGGU G CAUGGGCC | 2286 | GGCCCAUG GGAGGAAACUCC CU UCAAGGACAUCGUCCGGG ACCCCCGA | 3985 |
| 814 | GGGUGCAU G GGCCAGAA | 3585 | UUCUGGCC GGAGGAAACUCC CU UCAAGGACAUCGUCCGGG AUGCACCC | 3986 |
| 815 | GGUGCAUG G CCCAGAAG | 3586 | CUUCUGGC GGAGGAAACUCC CU UCAAGGACAUCGUCCGGG CAUGCACC | 3987 |
| 816 | GUGCAUGG G CCAGAAGG | 2287 | CCUUCUGG GGAGGAAACUCC CU UCAAGGACAUCGUCCGGG CCAUGCAC | 3988 |
| 820 | AUGGGCCA G AAGGAUUU | 3587 | AAAUCCUU GGAGGAAACUCC CU UCAAGGACAUCGUCCGGG UGGCCCAU | 3989 |
| 823 | GGCCAGAA G GAUUUCAU | 3588 | AUGAAAUC GGAGGAAACUCC CU UCAAGGACAUCGUCCGGG UUCUGGCC | 3990 |
| 824 | GCCAGAAC G AUUUCAUU | 3589 | AAUGAAAU GGAGGAAACUCC CU UCAAGGACAUCGUCCGGG CUUCUGGC | 3991 |
| 839 | UUAUAAAU G CAAAAUGG | 2288 | CCAUUUUG GGAGGAAACUCC CU UCAAGGACAUCGUCCGGG AUUUAUAA | 3992 |
| 846 | UGCAAAAU G GACAGAA | 3590 | UUCUGUCC GGAGGAAACUCC CU UCAAGGACAUCGUCCGGG AUUUUGCA | 3993 |
| 847 | GCAAAAUG G GACAGAAA | 3591 | UUUCUGUC GGAGGAAACUCC CU UCAAGGACAUCGUCCGGG CAUUUUGC | 3994 |
| 848 | CAAAAUGG G ACAGAAAG | 3592 | CUUUCUGU GGAGGAAACUCC CU UCAAGGACAUCGUCCGGG CCAUUUUG | 3995 |
| 852 | AUGGGACA G AAAGAAUA | 3593 | UAUUCUUU GGAGGAAACUCC CU UCAAGGACAUCGUCCGGG UGUCCCAU | 3996 |
| 856 | GACAGAAA G AAUAUAGU | 3594 | ACUAUAUU GGAGGAAACUCC CU UCAAGGACAUCGUCCGGG UUUCUGUC | 3997 |
| 863 | AGAAUAUA G UAUUGGUA | 2289 | UACCAAUA GGAGGAAACUCC CU UCAAGGACAUCGUCCGGG UAUAUUCU | 3998 |
| 868 | AUAGUAUU G GUACAGGU | 3595 | ACCUGUAC GGAGGAAACUCC CU UCAAGGACAUCGUCCGGG AAUACUAU | 3999 |
| 869 | UAGUAUUG G UACAGGUU | 2290 | AACCUGUA GGAGGAAACUCC CU UCAAGGACAUCGUCCGGG CAAUACUA | 4000 |
| 874 | UUGGUACA G GUUCUACU | 3596 | AGUAGAAC GGAGGAAACUCC CU UCAAGGACAUCGUCCGGG UGUACCAA | 4001 |
| 875 | UGGUACAG G UUCUACUA | 2291 | UAGUAGAA GGAGGAAACUCC CU UCAAGGACAUCGUCCGGG CUGUACCA | 4002 |
| 888 | ACUAAACA G GAAGCAAA | 3597 | UUUGCUUC GGAGGAAACUCC CU UCAAGGACAUCGUCCGGG UGUUUAGU | 4003 |
| 889 | CUAAACAG G AAGCAAAC | 3598 | UUUUGCUU GGAGGAAACUCC CU UCAAGGACAUCGUCCGGG CUGUUUAG | 4004 |
| 892 | AACAGGAA G CAAACAA | 2292 | UUGUUUUG GGAGGAAACUCC CU UCAAGGACAUCGUCCGGG UUCCUGUU | 4005 |
| 903 | AAACAAUU G GCCGCUAA | 3599 | UUAGCGGC GGAGGAAACUCC CU UCAAGGACAUCGUCCGGG AAUUGUUU | 4006 |
| 904 | AACAAUUG G CCGCUAAA | 2293 | UUUAGCGG GGAGGAAACUCC CU UCAAGGACAUCGUCCGGG CAAUUGUU | 4007 |
| 907 | AAUUGGCC G CUAAACUU | 2294 | AAGUUUAG GGAGGAAACUCC CU UCAAGGACAUCGUCCGGG GGCCAAUU | 4008 |
| 916 | CUAAACUU G CAUAUCUU | 2295 | AAGAUAUG GGAGGAAACUCC CU UCAAGGACAUCGUCCGGG AAGUUUAG | 4009 |
| 927 | UAUCUUCA G AUAUUAUC | 3600 | GAUAAUAU GGAGGAAACUCC CU UCAAGGACAUCGUCCGGG UGAAGAUA | 4010 |
| 937 | UAUUAUCA G AAGAAACC | 3601 | GGUUUCUU GGAGGAAACUCC CU UCAAGGACAUCGUCCGGG UGAUAAUA | 4011 |
| 940 | UAUCAGAA G AAACCUCA | 3602 | UGAGGUUU GGAGGAAACUCC CU UCAAGGACAUCGUCCGGG UUCUGAUA | 4012 |
| 949 | AAACCUCA G UGAAAUCU | 2296 | AGAUUUCA GGAGGAAACUCC CU UCAAGGACAUCGUCCGGG UGAGGUUU | 4013 |
| 951 | ACCUCAGU G AAAUCUGA | 3603 | UCAGAUUU GGAGGAAACUCC CU UCAAGGACAUCGUCCGGG ACUGAGGU | 4014 |
| 958 | UGAAAUCU G ACUACCUG | 3604 | CAGGUAGU GGAGGAAACUCC CU UCAAGGACAUCGUCCGGG AGAUUUCA | 4015 |
| 966 | GACUACCU G UCCCUCUG | 2297 | CCAGAGGA GGAGGAAACUCC CU UCAAGGACAUCGUCCGGG AGGUAGUC | 4016 |
| 973 | UGUCCCUCU G GUUCUUUU | 3605 | AAAAGAAC GGAGGAAACUCC CU UCAAGGACAUCGUCCGGG AGAGGACA | 4017 |
| 974 | GUCCUCUG G UUCUUUUG | 2298 | CAAAAGAA GGAGGAAACUCC CU UCAAGGACAUCGUCCGGG CAGAGGAC | 4018 |
| 982 | GUUCUUUU G CUACUACG | 2299 | CGUAGUAG GGAGGAAACUCC CU UCAAGGACAUCGUCCGGG AAAAGAAC | 4019 |
| 990 | GCUACUAC G UGUGACUC | 2300 | GACUCACA GGAGGAAACUCC CU UCAAGGACAUCGUCCGGG GUAGUAGC | 4020 |
| 992 | UACUACGU G UGAGUCCC | 2301 | GGGACUCA GGAGGAAACUCC CU UCAAGGACAUCGUCCGGG ACGUAGUA | 4021 |
| 994 | CUACUGUGU G AGUCCCAA | 3606 | UUGGGACU GGAGGAAACUCC CU UCAAAGGACUCGUCCGGG ACACGUAG | 4022 |
| 996 | ACGUGUGA G UCCCAAAG | 2302 | CUUUGGGA GGAGGAAACUCC CU UCAAAGGACUCGUCCGGG UCACACGU | 4023 |
| 1004 | GUCCCAAA G CAACUCUU | 2303 | AAGAGUUG GGAGGAAACUCC CU UCAAGGACAUCGUCCGGG UUUGGGAC | 4024 |
| 1015 | ACUCUUUA G UGACCAGC | 2304 | GCUGGUCA GGAGGAAACUCC CU UCAAGGACAUCGUCCGGG UAAAGAGU | 4025 |
| 1017 | UCUUUAGU G ACCAGCAC | 3607 | GUGCUGGU GGAGGAAACUCC CU UCAAGGACAUCGUCCGGG ACUAAAGA | 4026 |
| 1022 | AGUGACCA G CACACUCG | 2305 | CGAGUGUG GGAGGAAACUCC CU UCAAGGACAUCGUCCGGG UGGUCACU | 4027 |
| 1030 | GCACACUC G CUUCUGAA | 2306 | UUCAGAAG GGAGGAAACUCC CU UCAAGGACAUCGUCCGGG GAGUGUGC | 4028 |
| 1036 | UCGCUUCU G AAUCAUCA | 3608 | UGAUGAUU GGAGGAAACUCC CU UCAAGGACAUCGUCCGGG AGAAGCGA | 4029 |
| 1048 | CAUCAUCU G AAGGUGAC | 3609 | GUCACCUU GGAGGAAACUCC CU UCAAGGACAUCGUCCGGG AGAUGAUG | 4030 |
| 1051 | CAUCUGAA G GUGACUUC | 3610 | GAAGUCAC GGAGGAAACUCC CU UCAAGGACAUCGUCCGGG UUCAGAUG | 4031 |
| 1052 | AUCUGAAG G UGACUUCU | 2307 | AGAAGUCA GGAGGAAACUCC CU UCAAGGACAUCGUCCGGG CUUCAGAU | 4032 |
| 1054 | CUGAAGGU G ACUUCUCA | 3611 | UGAGAAGU GGAGGAAACUCC CU UCAAUGACAUCGUCCGGG ACCUUCAG | 4033 |
| 1063 | ACUUCUCA G CAGAUACA | 2308 | UGUAUCUG GGAGGAAACUCC CU UCAAGGACAUCGUCCGGG UGAGAAGU | 4034 |
| 1066 | UCUCAGCA G AUACAUCA | 3612 | UGAUGUAU GGAGGAAACUCC CU UCAAGGACAUCGUCCGGG UGCUGAGA | 4035 |
| 1075 | AUACAUCA G AGAUAAAU | 3613 | AUUUAUCU GGAGGAAACUCC CU UCAAGGACAUCGUCCGGG UGAUGUAU | 4036 |
| 1077 | ACAUCAGA G AUAAAUUC | 3614 | GAAUUUAU GGAGGAAACUCC CU UCAAGGACAUCGUCCGGG UCUGAUGU | 4037 |
| 1091 | UUCUAACA G UUCAGUU | 2309 | AACUGUCA GGAGGAAACUCC CU UCAAGGACAUCGUCCGGG UGUUAGAA | 4038 |
| 1093 | CUAACAGU G ACAGUUUA | 3615 | UAAACUGU GGAGGAAACUCC CU UCAAGGACAUCGUCCGGG ACUGUUAG | 4039 |
| 1097 | CAGUGACA G UUUAAACA | 2310 | UGUUUAAA GGAGGAAACUCC CU UCAAGGACAUCGUCCGGG UGUCACUG | 4040 |
| 1106 | UUUAAACA G UUCUUCGU | 2311 | ACGAAGAA GGAGGAAACUCC CU UCAAGGACAUCGUCCGGG UGUUUAAA | 4041 |
| 1113 | AUUUCUUC G UUGCUUAU | 2312 | AUAAGCAA GGAGGAAACUCC CU UCAAGGACAUCGUCCGGG GAAGAACU | 4042 |
| 1116 | UCUUCCUU G CUUAUGAA | 2313 | UUCAUAAG GGAGGAAACUCC CU UCAAGGACAUCGUCCGGG AACGAAGA | 4043 |
| 1122 | UUGCUUAU G AAUGGCUC | 3616 | AGACCAUU GGAGGAAACUCC CU UCAAGGACAUCGUCCGGG AUAAGCAA | 4044 |
| 1126 | UUAUGAAU G GUCUCAGA | 3617 | UCUGAGAC GGAGGAAACUCC CU UCAAGGACAUCGUCCGGG AUUCAUAA | 4045 |
| 1127 | UAUGAAUG G UCUCAGAA | 2314 | UUCCUGAGA GGAGGAAACUCC CU UCAAGGACAUCGUCCGGG CAUUCAUA | 4046 |
| 1133 | UGGUCUCA G AAAUAAUC | 3618 | GAUUAUUU GGAGGAAACUCC CU UCAAGGACAUCGUCCGGG UGAGACCA | 4047 |
| 1145 | UAAUCAAA G AAGGCAA | 3619 | UUGCCUUC GGAGGAAACUCC CU UCAAGGACAUCGUCCGGG UUUGAUUA | 4048 |
| 1146 | AAUCAAAG G AAGGCAAA | 3620 | UUUGCCUU GGAGGAAACUCC CU UCAAGGACAUCGUCCGGG CUUUGAUU | 4049 |
| 1149 | CAAAGGAA G GCAAAAAG | 3621 | CUUUUUGC GGAGGAAACUCC CU UCAAGGACAUCGUCCGGG UUCCUUUG | 4050 |

TABLE XII-continued

Human PKR Amberzyme and Substrate Sequence

| Pos | Substrate | Seq ID | Amberzyme | Seq ID |
|---|---|---|---|---|
| 1150 | AAAGGAAG G CAAAAAGA | 2315 | UCUUUUUG GGAGGAAACUCC CU UCAAGGACAUCGUCCGGG CUUCCUUU | 4051 |
| 1157 | GGCAAAAA G AUCUUUGG | 3622 | CCAAAGAU GGAGGAAACUCC CU UCAAGGACAUCGUCCGGG UUUUUGCC | 4052 |
| 1164 | AGAUCUUU G CACCCAG | 3623 | CUGGGUGC GGAGGAAACUCC CU UCAAGGACAUCGUCCGGG AAAGAUCU | 4053 |
| 1165 | GAUCUUUG G CACCCAGA | 2316 | UCUGGGUG GGAGGAAACUCC CU UCAAGGACAUCGUCCGGG CAAAGAUC | 4054 |
| 1172 | GGCACCCA G AUUUGACC | 3624 | GGUCAAAU GGAGGAAACUCC CU UCAAGGACAUCGUCCGGG UGGGUGCC | 4055 |
| 1177 | CCAGAUUU G ACCUUCCU | 3625 | AGGAAGGU GGAGGAAACUCC CU UCAAGGACAUCGUCCGGG AAAUCUGG | 4056 |
| 1186 | ACCUUCCU G ACAUGAAA | 3626 | UUUCAUGU GGAGGAAACUCC CU UCAAGGACAUCGUCCGGG AGGAAGGU | 4057 |
| 1191 | CCUGACAU G AAAGAAAC | 3627 | GUUUCUUU GGAGGAAACUCC CU UCAAGGACAUCGUCCGGG AUGUCAGG | 4058 |
| 1195 | ACAUGAAA G AAACAAAG | 3628 | CUUUGUUU GGAGGAAACUCC CU UCAAGGACAUCGUCCGGG UUUCAUGU | 4059 |
| 1203 | GAAACAAA G UAUACUGU | 2317 | ACAGUAUA GGAGGAAACUCC CU UCAAGGACAUCGUCCGGG UUUGUUUC | 4060 |
| 1210 | AGUAUACU G UGGACAAG | 2318 | CUUGUCCA GGAGGAAACUCC CU UCAAGGACAUCGUCCGGG AGUAUACU | 4061 |
| 1212 | UAUACUGU G GACAAGAG | 3629 | CUCUUGUC GGAGGAAACUCC CU UCAAGGACAUCGUCCGGG ACAGUAUA | 4062 |
| 1213 | AUACUGUG G ACAAGAGG | 3630 | CCUCUUGU GGAGGAAACUCC CU UCAAGGACAUCGUCCGGG CACAGUAU | 4063 |
| 1218 | GUGGACAA G AGGUUUGG | 3631 | CCAAACCU GGAGGAAACUCC CU UCAAGGACAUCGUCCGGG UUGUCCAC | 4064 |
| 1220 | GGACAAGA G GUUUGGCA | 3632 | UGCCAAAC GGAGGAAACUCC CU UCAAGGACAUCGUCCGGG UCUUGUCC | 4065 |
| 1221 | GACAAGAG G UUUGGCAU | 2319 | AUGCCAAA GGAGGAAACUCC CU UCAAGGACAUCGUCCGGG CUCUUGUC | 4066 |
| 1225 | AGAGGUUU G GCAUGGAU | 3633 | AUCCAUGC GGAGGAAACUCC CU UCAAGGACAUCGUCCGGG AAACCUCU | 4067 |
| 1226 | GAGGUUUG G CAUGGAUU | 2320 | AAUCCAUG GGAGGAAACUCC CU UCAAGGACAUCGUCCGGG CAAACCUC | 4068 |
| 1230 | UUUGGCAU G GAUUUUAA | 3634 | UUAAAAUC GGAGGAAACUCC CU UCAAGGACAUCGUCCGGG AUGCCAAA | 4069 |
| 1231 | UUCGGAUC G AUUUUAAA | 3635 | UUUAAAAU GGAGGAAACUCC CU UCAAGGACAUCGUCCGGG CAUGCCAA | 4070 |
| 1240 | AUUUUAAA G AAAUACAA | 3636 | UUCUAUUU GGAGGAAACUCC CU UCAAGGACAUCGUCCGGG UUUAAAAU | 4071 |
| 1246 | AAGAAAUA G AAUUAAUU | 3637 | AAUUAAUU GGAGGAAACUCC CU UCAAGGACAUCGUCCGGG UAUUUCUU | 4072 |
| 1255 | AAUUAAUU G CUCAGGU | 3638 | ACCUGAGC GGAGGAAACUCC CU UCAAGGACAUCGUCCGGG AAUUAAUU | 4073 |
| 1256 | AUUAAUUG G CUCAGGUG | 2321 | CACCUGAG GGAGGAAACUCC CU UCAAGGACAUCGUCCGGG CAAUUAAU | 4074 |
| 1261 | UUGGCUCA G UGGAUUUG | 3639 | AAAUCCAC GGAGGAAACUCC CU UCAAGGACAUCGUCCGGG UGAGCCAA | 4075 |
| 1262 | UGGCUCAC G UGGAUUUG | 2322 | CAAAUCCA GGAGGAAACUCC CU UCAAGGACAUCGUCCGGG CUGAGCCA | 4076 |
| 1264 | GCUCAGGU G AUUUGGC | 3640 | GCCAAAUC GGAGGAAACUCC CU UCAAGGACAUCGUCCGGG ACCUGAGC | 4077 |
| 1265 | CUCAGGUG G AUUUGGCC | 3641 | GGCCAAAU GGAGGAAACUCC CU UCAAGGACAUCGUCCGGG CACCUGAG | 4078 |
| 1270 | GUGGAUUU G GCCAAGUU | 3642 | AACUUGGC GGAGGAAACUCC CU UCAAGGACAUCGUCCGGG AAAUCCAC | 4079 |
| 1271 | UGGAUUUG G CCAAGUUU | 2323 | AAACUUGG GGAGGAAACUCC CU UCAAGGACAUCGUCCGGG CAAAUCCA | 4080 |
| 1276 | UUGGCCAA G UUUCAAA | 2324 | UUUGAAAA GGAGGAAACUCC CU UCAAGGACAUCGUCCGGG UUGGCCAA | 4081 |
| 1285 | UUUUCAAA G CAAAACAC | 2325 | GUGUUUUG GGAGGAAACUCC CU UCAAGGACAUCGUCCGGG UUUGAAAA | 4082 |
| 1295 | AAAACACA G AAUUGACG | 3643 | CGUCAAUU GGAGGAAACUCC CU UCAAGGACAUCGUCCGGG UGUGUUUU | 4083 |
| 1300 | ACAGAAUU G ACGGAAAG | 3644 | CUUUCCGU GGAGGAAACUCC CU UCAAGGACAUCGUCCGGG AAUUCUGU | 4084 |
| 1303 | GAAUUGAC G GAAAGACU | 3645 | AGUCUUUC GGAGGAAACUCC CU UCAAGGACAUCGUCCGGG GUCAAUUC | 4085 |
| 1304 | AAUUGACG G AAAGACUU | 3646 | AACUCUUU GGAGGAAACUCC CU UCAAGGACAUCGUCCGGG CGUCAAUU | 4086 |
| 1308 | GACGGAAA G ACUUACGU | 3647 | ACGUAAGU GGAGGAAACUCC CU UCAAGGACAUCGUCCGGG UUUCCGUC | 4087 |
| 1315 | AGACUUAC G UUAUUAAA | 2326 | UUUAAUAA GGAGGAAACUCC CU UCAAGGACAUCGUCCGGG GUAAGUCU | 4088 |
| 1325 | UAUUAAAC G UGUUAAAU | 2327 | AUUUAACA GGAGGAAACUCC CU UCAAGGACAUCGUCCGGG GUUUAAUA | 4089 |
| 1327 | UUAAACGU G UUAAAUAU | 2328 | AUAUUUAA GGAGGAAACUCC CU UCAAGGACAUCGUCCGGG ACGUUUAA | 4090 |
| 1342 | AUAAUAAC G AAGGCGA | 3648 | CGCCUUCU GGAGGAAACUCC CU UCAAGGACAUCGUCCGGG GUUAUUAU | 4091 |
| 1344 | AAUAACGA G AAGGCGGA | 3649 | UCCGCCUU GGAGGAAACUCC CU UCAAGGACAUCGUCCGGG UCGUUAUU | 4092 |
| 1347 | AACGAGAA G GCGGAGCG | 3650 | CGCUCCGC GGAGGAAACUCC CU UCAAGGACAUCGUCCGGG UUCUCGUU | 4093 |
| 1348 | ACGAGAAG G CGGAGCGU | 2329 | ACGCUCCG GGAGGAAACUCC CU UCAAGGACAUCGUCCGGG CUUCUCGU | 4094 |
| 1350 | GAGAAGGC G AGCGUGA | 3651 | UCACGCUC GGAGGAAACUCC CU UCAAGGACAUCGUCCGGG GCCUUCUC | 4095 |
| 1351 | AGAAGGCG G AGCGUGAA | 3652 | UUCACGCU GGAGGAAACUCC CU UCAAGGACAUCGUCCGGG CGCCUUCU | 4096 |
| 1353 | AAGGCGGA G CGUGAAGU | 2330 | ACUUCACG GGAGGAAACUCC CU UCAAGGACAUCGUCCGGG UCCGCCUU | 4097 |
| 1355 | GGCGGAGC G UGAAGUAA | 2331 | UUACUUCA GGAGGAAACUCC CU UCAAGGACAUCGUCCGGG CCUCCGCC | 4098 |
| 1357 | CGGAGCGU G AAGUAAAA | 3653 | UUUUACUU GGAGGAAACUCC CU UCAAGGACAUCGUCCGGG ACGCUCCG | 4099 |
| 1360 | AGCGUGAA G UAAAAGCA | 2332 | UGCUUUUA GGAGGAAACUCC CU UCAAGGACAUCGUCCGGG UUCACGCU | 4100 |
| 1366 | AAGUAAAA G CAUUGGCA | 2333 | UGCCAAUG GGAGGAAACUCC CU UCAAGGACAUCGUCCGGG UUUUACUU | 4101 |
| 1371 | AAAGCAUU G GCAAAACU | 3654 | AGUUUUGC GGAGGAAACUCC CU UCAAGGACAUCGUCCGGG AAUGCUUU | 4102 |
| 1372 | AAGCAUUG G CAAAACUU | 2334 | AAGUUUUG GGAGGAAACUCC CU UCAAGGACAUCGUCCGGG CAAUGCUU | 4103 |
| 1381 | CAAAACUU G AUCAUGUA | 3655 | UACAUGAU GGAGGAAACUCC CU UCAAGGACAUCGUCCGGG AAGUUUUG | 4104 |
| 1387 | UUGAUCAU G UAAAUAUU | 2335 | AAUAUUUA GGAGGAAACUCC CU UCAAGGACAUCGUCCGGG AUGAUCAA | 4105 |
| 1396 | UAAAUAUU G UUCACUAC | 2336 | GUAGUGAA GGAGGAAACUCC CU UCAAGGACAUCGUCCGGG AAUAUUUA | 4106 |
| 1408 | ACUACAAU G CCUGUUGG | 3656 | CCAACAGC GGAGGAAACUCC CU UCAAGGACAUCGUCCGGG AUUGUAGU | 4107 |
| 1409 | CUACAAUG G CCUGUUGGG | 2337 | CCCAACAG GGAGGAAACUCC CU UCAAGGACAUCGUCCGGG CAUUGUAC | 4108 |
| 1412 | CAAUGGCU G UUGGGAUC | 2338 | CAUCCCAA GGAGGAAACUCC CU UCAAGGACAUCGUCCGGG AGCCAUUG | 4109 |
| 1415 | UGGCUGUU G GAUGGAU | 3657 | AUCCAUCC GGAGGAAACUCC CU UCAAGGACAUCGUCCGGG AACAGCCA | 4110 |
| 1416 | GGCUGUUG G AUGGAUU | 3658 | AAUCCAUC GGAGGAAACUCC CU UCAAGGACAUCGUCCGGG CAACAGCC | 4111 |
| 1417 | GCUGUUGG G AUGGAUGG | 3659 | AAAUCCAU GGAGGAAACUCC CU UCAAGGACAUCGUCCGGG CCAACAGC | 4112 |
| 1420 | GUUGGGAU G GAUUUGAU | 3660 | AUCAAAUC GGAGGAAACUCC CU UCAAGGACAUCGUCCGGG AUCCCAAC | 4113 |
| 1421 | UUGGGAUG G AUUUGAUU | 3661 | AAUCAAAU GGAGGAAACUCC CU UCAAGGACAUCGUCCGGG CAUCCCAA | 4114 |
| 1426 | AUCCAUUU G AUUAUGAU | 3662 | AUCAUAAU GGAGGAAACUCC CU UCAAGGACAUCGUCCGGG AAAUCCAU | 4115 |
| 1432 | UUGAUUAU G AUCCUGAG | 3663 | CUCAGGAU GGAGGAAACUCC CU UCAAGGACAUCGUCCGGG AUAAUCAA | 4116 |
| 1438 | AUGAUCCU G AGACCAGU | 3664 | ACUGGUCU GGAGGAAACUCC CU UCAAGGACAUCGUCCGGG AGGAUCAU | 4117 |
| 1440 | GAUCCUGA G ACCAGUGA | 3665 | UCACUGGU GGAGGAAACUCC CU UCAAGGACAUCGUCCGGG UCAGGAUC | 4118 |
| 1445 | UGAGACCA G UGAUGAUU | 2339 | AAUCAUCA GGAGGAAACUCC CU UCAAGGACAUCGUCCGGG UGGUCUCA | 4119 |
| 1447 | AGACCAGU G AUGAUUCU | 3666 | AGAAUCAU GGAGGAAACUCC CU UCAAGGACAUCGUCCGGG ACUGGUCU | 4120 |
| 1450 | CCAGUGAU G AUUCUCUU | 3667 | AAGAGAAU GGAGGAAACUCC CU UCAAGGACAUCGUCCGGG AUCACUGG | 4121 |
| 1459 | AUUCUCUU G AGCAGUGA | 3668 | ACUGCUCU GGAGGAAACUCC CU UCAAGGACAUCGUCCGGG AAGAGAAU | 4122 |
| 1461 | UCUCUUGA G AGCAGUGA | 3669 | UCACUGCU GGAGGAAACUCC CU UCAAGGACAUCGUCCGGG UCAAGAGA | 4123 |
| 1463 | UCUUGAGA G CAGUGAUU | 2340 | AAUCACUG GGAGGAAACUCC CU UCAAGGACAUCGUCCGGG UCUCAAGA | 4124 |
| 1466 | UGAGAUCA G UGAUUAUG | 2341 | CAUAAUCA GGAGGAAACUCC CU UCAAGGACAUCGUCCGGG UGCUCUCA | 4125 |

TABLE XII-continued

Human PKR Amberzyme and Substrate Sequence

| Pos | Substrate | Seq ID | Amberzyme | Seq ID |
|---|---|---|---|---|
| 1468 | AGAGCAGU G AUUAUGAU | 3670 | AUCAUAAU GGAGGAAACUCC CU UCAAGGACAUCGUCCGGG ACUGCUCU | 4126 |
| 1474 | GUGAUUAU G AUCCUGAG | 3671 | CUCAGGAU GGAGGAAACUCC CU UCAAGGACAUCGUCCGGG AUAAUCAC | 4127 |
| 1480 | AUGAUCCU G AGAACAGC | 3672 | GCUGUUCU GGAGGAAACUCC CU UCAAGGACAUCGUCCGGG AGGAUCAU | 4128 |
| 1482 | GAUCCUGA G AACAGCAA | 3673 | UUGCUGUU GGAGGAAACUCC CU UCAAGGACAUCGUCCGGG UCAGGAUC | 4129 |
| 1487 | UGAGAACA G CAAAAAUA | 2342 | UAUUUUUG GGAGGAAACUCC CU UCAAGGACAUCGUCCGGG UGUUCUCA | 4130 |
| 1496 | CAAAAAUA G UUCAAGGU | 2343 | ACCUUGAA GGAGGAAACUCC CU UCAAGGACAUCGUCCGGG UAUUUUUG | 4131 |
| 1502 | UAGUUCAA G GUCAAAGA | 3674 | UCUUUGAC GGAGGAAACUCC CU UCAAGGACAUCGUCCGGG UUGAACUA | 4132 |
| 1503 | AGUUCAAG G UCAAAGAC | 2344 | GUCUUUGA GGAGGAAACUCC CU UCAAGGACAUCGUCCGGG CUUGAACU | 4133 |
| 1509 | AGGUCAAA G ACUAAGUG | 3675 | CACUUAGU GGAGGAAACUCC CU UCAAGGACAUCGUCCGGG UUUGACCU | 4134 |
| 1515 | AAGACUAA G UGCCUUUU | 2345 | AAAAGGCA GGAGGAAACUCC CU UCAAGGACAUCGUCCGGG UUAGUCUU | 4135 |
| 1517 | GACUAAGU G CCUUUUCA | 2346 | UGAAAAGG GGAGGAAACUCC CU UCAAGGACAUCGUCCGGG ACUUAGUC | 4136 |
| 1533 | AUCCAAAU G GAAUUCUG | 3676 | CAGAAUUC GGAGGAAACUCC CU UCAAGGACAUCGUCCGGG AUUUGGAU | 4137 |
| 1534 | UCCAAAUG G AAUUCUGU | 3677 | ACAGAAUU GGAGGAAACUCC CU UCAAGGACAUCGUCCGGG CAUUUGUA | 4138 |
| 1541 | GGAAUUCU G UGAUAAAG | 2347 | CUUUAUCA GGAGGAAACUCC CU UCAAGGACAUCGUCCGGG AGAAUUCC | 4139 |
| 1543 | AAUUCUGU G AUAAAGGG | 3678 | CCCUUUAU GGAGGAAACUCC CU UCAAGGACAUCGUCCGGG ACAGAAUU | 4140 |
| 1549 | GUGAUAAA G GUACCUUG | 3679 | CAAGGUCC GGAGGAAACUCC CU UCAAGGACAUCGUCCGGG UUUAUCAC | 4141 |
| 1550 | UGAUAAAG G UACCUUGG | 3680 | CCAAGGUC GGAGGAAACUCC CU UCAAGGACAUCGUCCGGG CUUUAUCA | 4142 |
| 1551 | GAUAAAGG G UACCUUGA | 3681 | UCCAAGGU GGAGGAAACUCC CU UCAAGGACAUCGUCCGGG CCUUUAUC | 4143 |
| 1557 | GGGACCUU G AACAAUG | 3682 | CAUUGUUC GGAGGAAACUCC CU UCAAGGACAUCGUCCGGG AAGGUCCC | 4144 |
| 1558 | UGACCUUG G AACAAUGG | 3683 | CCAUUGUU GGAGGAAACUCC CU UCAAGGACAUCGUCCGGG CAAGGUCC | 4145 |
| 1565 | GGAACAAU G GAUUGAAA | 3684 | UUUCAAUC GGAGGAAACUCC CU UCAAGGACAUCGUCCGGG AUUGUUCC | 4146 |
| 1566 | GAACAAUG G AUUGAAAA | 3685 | UUUUCAAU GGAGGAAACUCC CU UCAAGGACAUCGUCCGGG CAUUGUUC | 4147 |
| 1570 | AAUGGAUU G AAAAAGA | 3686 | UCUUUUUU GGAGGAAACUCC CU UCAAGGACAUCGUCCGGG AAUCCAUU | 4148 |
| 1577 | UGAAAAAA G AAGAGGCG | 3687 | CGCCUCUU GGAGGAAACUCC CU UCAAGGACAUCGUCCGGG UUUUUUCA | 4149 |
| 1580 | AAAAAGAA G AGGCGAGA | 3688 | UCUCGCCU GGAGGAAACUCC CU UCAAGGACAUCGUCCGGG UUCUUUUU | 4150 |
| 1582 | AAAGAAGA G CGAGAAA | 3689 | UUUCUCGC GGAGGAAACUCC CU UCAAGGACAUCGUCCGGG UCUUCUUU | 4151 |
| 1583 | AAGAAGAG G CGAGAAAC | 2348 | GUUUCUCG GGAGGAAACUCC CU UCAAGGACAUCGUCCGGG CUCUUCUU | 4152 |
| 1585 | GAAGAGGC G AGAAACUA | 3690 | UAGUUUCU GGAGGAAACUCC CU UCAAGGACAUCGUCCGGG GCCUCUUC | 4153 |
| 1587 | AGAGGCGA G AAACUAGA | 3691 | UCUAGUUU GGAGGAAACUCC CU UCAAGGACAUCGUCCGGG UCGCCUCU | 4154 |
| 1594 | AGAAACUA G ACAAAGUU | 3692 | AACUUUGU GGAGGAAACUCC CU UCAAGGACAUCGUCCGGG UAGUUUCU | 4155 |
| 1600 | UAGACAAA G UUUUGGCU | 2349 | AGCCAAAA GGAGGAAACUCC CU UCAAGGACAUCGUCCGGG UUUGUCUA | 4156 |
| 1605 | AAAGUUUU G GCUUUGGA | 3693 | UCCAAAGC GGAGGAAACUCC CU UCAAGGACAUCGUCCGGG AAAACUUU | 4157 |
| 1606 | AAGUUUUG G CUUUGGAA | 2350 | UUCCAAAG GGAGGAAACUCC CU UCAAGGACAUCGUCCGGG CAAAACUU | 4158 |
| 1611 | UUGGCUUU G GAACUCUU | 3694 | AAGAGUUC GGAGGAAACUCC CU UCAAGGACAUCGUCCGGG AAAGCCAA | 4159 |
| 1612 | UGGCUUUG G AACUCUUU | 3695 | AAAGAGUU GGAGGAAACUCC CU UCAAGGACAUCGUCCGGG CAAAGCCA | 4160 |
| 1621 | AACUCUUU G AACAAAUA | 3696 | UAUUUGUU GGAGGAAACUCC CU UCAAGGACAUCGUCCGGG AAAGAGUU | 4161 |
| 1636 | UAACAAAA G GGGUGGAU | 3697 | AUCCACCC GGAGGAAACUCC CU UCAAGGACAUCGUCCGGG UUUUGUUA | 4162 |
| 1637 | AACAAAAC G GUGGAUU | 3698 | AAUCCACC GGAGGAAACUCC CU UCAAGGACAUCGUCCGGG CUUUUGUU | 4163 |
| 1638 | ACAAAAGG G UGGAUUA | 3699 | UAAUCCAC GGAGGAAACUCC CU UCAAGGACAUCGUCCGGG CCUUUUGU | 4164 |
| 1639 | CAAAAGGG G UGGAUUAU | 2351 | AUAAUCCA GGAGGAAACUCC CU UCAAGGACAUCGUCCGGG CCCUUUUG | 4165 |
| 1641 | AAAGGGGU G GAUUAUA | 3700 | AUAUAAUC GGAGGAAACUCC CU UCAAGGACAUCGUCCGGG ACCCCUUU | 4166 |
| 1642 | AAGGGGUG G AUUAUAUA | 3701 | UAUAUAAU GGAGGAAACUCC CU UCAAGGACAUCGUCCGGG CACCCCUU | 4167 |
| 1673 | AAUUCAUA G AGAUCUUA | 3702 | UAAGAUCU GGAGGAAACUCC CU UCAAGGACAUCGUCCGGG UAUGAAUU | 4168 |
| 1675 | UUCAUAGA G AUCUUAAG | 3703 | CUUAAGAU GGAGGAAACUCC CU UCAAGGACAUCGUCCGGG UCUAUGAA | 4169 |
| 1683 | GAUCUUAA G CCAAGUAA | 2352 | UUACUUGG GGAGGAAACUCC CU UCAAGGACAUCGUCCGGG UUAAGAUC | 4170 |
| 1688 | UAAGCCAA G UAAUAUAU | 2353 | AUAUAUUA GGAGGAAACUCC CU UCAAGGACAUCGUCCGGG UUGGCUUA | 4171 |
| 1702 | UAUUCUUA G UAGAUACA | 2354 | UGUAUCUA GGAGGAAACUCC CU UCAAGGACAUCGUCCGGG UAAGAAUA | 4172 |
| 1705 | UCUUAGUA G AUACAAAA | 3704 | UUUUGUAU GGAGGAAACUCC CU UCAAGGACAUCGUCCGGG UACUAAGA | 4173 |
| 1717 | CAAAACAA G UAAAGAUU | 2355 | AAUCUUUA GGAGGAAACUCC CU UCAAGGACAUCGUCCGGG UUGUUUUG | 4174 |
| 1722 | CAAGUAAA G AUUGGAGA | 3705 | UCUCCAAU GGAGGAAACUCC CU UCAAGGACAUCGUCCGGG UUUACUUG | 4175 |
| 1726 | UAAAGAUU G GACACUUU | 3706 | AAAGUCUC GGAGGAAACUCC CU UCAAGGACAUCGUCCGGG AAUCUUUA | 4176 |
| 1727 | AAAGAUUC G AGACUUUG | 3707 | CAAAGUCU GGAGGAAACUCC CU UCAAGGACAUCGUCCGGG CAAUCUUU | 4177 |
| 1729 | AGAUUGGA G ACUUUGGA | 3708 | UCCAAAGU GGAGGAAACUCC CU UCAAGGACAUCGUCCGGG UCCAAUCU | 4178 |
| 1735 | GAGACUUU G ACUUGUAA | 3709 | UACAAGUC GGAGGAAACUCC CU UCAAGGACAUCGUCCGGG AAAGUCUC | 4179 |
| 1736 | AGACUUUG G ACUUGUAA | 3710 | UUACAAGU GGAGGAAACUCC CU UCAAGGACAUCGUCCGGG CAAAGUCU | 4180 |
| 1741 | UUGGACUU G UAACAUCU | 2356 | ACAUGUUA GGAGGAAACUCC CU UCAAGGACAUCGUCCGGG AAGUCCAA | 4181 |
| 1752 | ACAUCUCU G AAAAAUGA | 3711 | UCAUUUUU GGAGGAAACUCC CU UCAAGGACAUCGUCCGGG AGAGAUGU | 4182 |
| 1759 | UGAAAAAU G AUGGAAAG | 3712 | CUUUCCAU GGAGGAAACUCC CU UCAAGGACAUCGUCCGGG AUUUUUCA | 4183 |
| 1762 | AAAAUGAU G GAAAGCGA | 3713 | UCGCUUUC GGAGGAAACUCC CU UCAAGGACAUCGUCCGGG AUCAUUUU | 4184 |
| 1763 | AAAUGAUG G AAAGCGAA | 3714 | UUCGCUUU GGAGGAAACUCC CU UCAAGGACAUCGUCCGGG CAUCAUUU | 4185 |
| 1767 | GAUGGAAA G CGAACAAG | 2357 | CUUGUUCG GGAGGAAACUCC CU UCAAGGACAUCGUCCGGG UUUCCAUC | 4186 |
| 1769 | UGGAAAGC G AACAAGGA | 3715 | UCCUUGUG GGAGGAAACUCC CU UCAAGGACAUCGUCCGGG GCUUUCCA | 4187 |
| 1775 | GCGAACAA G GAGUAAGG | 3716 | CCUUACUC GGAGGAAACUCC CU UCAAGGACAUCGUCCGGG UUGUUCGC | 4188 |
| 1776 | CGAACAAG G ACUAAGGG | 3717 | CCCUUACU GGAGGAAACUCC CU UCAAGGACAUCGUCCGGG CUUGUUCG | 4189 |
| 1778 | AACAAGGA G UAAGGGAA | 2358 | UUCCCUUA GGAGGAAACUCC CU UCAAGGACAUCGUCCGGG UCCUUGUU | 4190 |
| 1782 | AGGAGUAA G GGAACUUU | 3718 | AAAGUUCC GGAGGAAACUCC CU UCAAGGACAUCGUCCGGG UUACUCCU | 4191 |
| 1783 | GGAGUAAG G GAACUUUG | 3719 | CAAAGUUC GGAGGAAACUCC CU UCAAGGACAUCGUCCGGG CUUACUCC | 4192 |
| 1784 | GAGUAAGG G AACUUUGC | 3720 | GCAAAGUU GGAGGAAACUCC CU UCAAGGACAUCGUCCGGG CCUUACUC | 4193 |
| 1791 | GGAACUUU G CGAUACAU | 2359 | AUGUAUCG GGAGGAAACUCC CU UCAAGGACAUCGUCCGGG AAAGUUCC | 4194 |
| 1793 | AACUUUGC G AUACAUGA | 3721 | UCAUGUAU GGAGGAAACUCC CU UCAAGGACAUCGUCCGGG GCAAAGUU | 4195 |
| 1800 | CGAUACAU G AGCCCAGA | 3722 | UCUGGGCU GGAGGAAACUCC CU UCAAGGACAUCGUCCGGG AUGUAUCG | 4196 |
| 1802 | AUACAUGA G CCCAGAAC | 2360 | GUUCUGGG GGAGGAAACUCC CU UCAAGGACAUCGUCCGGG UCAUGUAU | 4197 |
| 1807 | UGAGCCCA G AACAGAUU | 3723 | AAUCUGUU GGAGGAAACUCC CU UCAAGGACAUCGUCCGGG UGGGCUCA | 4198 |
| 1812 | CCAGAACA G AUUUCUUC | 3724 | GAAGAAAU GGAGGAAACUCC CU UCAAGGACAUCGUCCGGG UGUUCUGG | 4199 |
| 1821 | AUUUCUUC G CAAGACUA | 2361 | UAGUCUUG GGAGGAAACUCC CU UCAAGGACAUCGUCCGGG GAAGAAAU | 4200 |

TABLE XII-continued

Human PKR Amberzyme and Substrate Sequence

| Pos | Substrate | Seq ID | Amberzyme | Seq ID |
|---|---|---|---|---|
| 1825 | CUUCGCAA G ACUAUGGA | 3725 | UCCAUAGU GGAGGAAACUCC CU UCAAGGACAUCGUCCGGG UUGCGAAG | 4201 |
| 1831 | AAGACUAU G GAAAGGAA | 3726 | UUCCUUUC GGAGGAAACUCC CU UCAAGGACAUCGUCCGGG AUAGUCUU | 4202 |
| 1832 | AGACUAUG G AAAGGAAG | 3727 | CUUCCUUU GGAGGAAACUCC CU UCAAGGACAUCGUCCGGG CAUAGUCU | 4203 |
| 1836 | UAUGGAAA G AAGUGGA | 3728 | UCCACUUC GGAGGAAACUCC CU UCAAGGACAUCGUCCGGG UUUCCAUA | 4204 |
| 1837 | AUGGAAAC G AAGUGGAC | 3729 | GUCCACUU GGAGGAAACUCC CU UCAAGGACAUCGUCCGGG CUUUCCAU | 4205 |
| 1840 | GAAAGGAA G UGGACCUC | 2362 | GAGGUCCA GGAGGAAACUCC CU UCAAGGACAUCGUCCGGG UUCCUUUC | 4206 |
| 1842 | AAGGAAGU G GACCUCUA | 3730 | UAGAGGUC GGAGGAAACUCC CU UCAAGGACAUCGUCCGGG ACUUCCUU | 4207 |
| 1843 | AGGAAGUG G ACCUCUAC | 3731 | GUAGAGGU GGAGGAAACUCC CU UCAAGGACAUCGUCCGGG CACUUCCU | 4208 |
| 1852 | ACCUCUAC G CUUUGGGG | 2363 | CCCCAAAG GGAGGAAACUCC CU UCAAGGACAUCGUCCGGG GUAGAGGU | 4209 |
| 1857 | UACGCUUU G GGCUAAUU | 3732 | AUUAGCCC GGAGGAAACUCC CU UCAAGGACAUCGUCCGGG AAAGCGUA | 4210 |
| 1858 | ACGCUUUG G GCUAAUUC | 3733 | AAUUAGCC GGAGGAAACUCC CU UCAAGGACAUCGUCCGGG CAAAGCGU | 4211 |
| 1859 | CGCUUUGG G CUAAUUC | 3734 | GAAUUAGC GGAGGAAACUCC CU UCAAGGACAUCGUCCGGG CCAAAGCG | 4212 |
| 1860 | GCUUUGGG G CUAAUUCU | 2364 | AGAAUUAG GGAGGAAACUCC CU UCAAGGACAUCGUCCGGG CCCAAAGC | 4213 |
| 1870 | UAAUUCUU G CUGAACUU | 2365 | AAGUUCAG GGAGGAAACUCC CU UCAAGGACAUCGUCCGGG AAGAAUUA | 4214 |
| 1873 | UUCUUGCU G AACUUCUU | 3735 | AAGAAGUU GGAGGAAACUCC CU UCAAGGACAUCGUCCGGG AGCAACAA | 4215 |
| 1885 | UUCUUCAU G UAUGUGAC | 2366 | GUCACAUA GGAGGAAACUCC CU UCAAGGACAUCGUCCGGG AUGAAGAA | 4216 |
| 1889 | UCAUGUAU G UGACACUG | 2367 | CAGUGUCA GGAGGAAACUCC CU UCAAGGACAUCGUCCGGG AUACAUGA | 4217 |
| 1891 | AUGUAUGU G ACACUGCU | 3736 | AGCAGUGU GGAGGAAACUCC CU UCAAGGACAUCGUCCGGG ACAUACAU | 4218 |
| 1897 | GUGACACU G CUUUUGAA | 2368 | UUCAAAAG GGAGGAAACUCC CU UCAAGGACAUCGUCCGGG AGUGUCAC | 4219 |
| 1903 | CUGCUUUU G AAACAUCA | 3737 | UGAUGUUU GGAGGAAACUCC CU UCAAGGACAUCGUCCGGG AAAAGCAG | 4220 |
| 1914 | ACAUCAAA G UUUUUCAC | 2369 | GUGAAAAA GGAGGAAACUCC CU UCAAGGACAUCGUCCGGG UUUGAUGU | 4221 |
| 1924 | UUUUCACA G ACCUACGG | 3738 | CCGUAGGU GGAGGAAACUCC CU UCAAGGACAUCGUCCGGG UGUGAAAA | 4222 |
| 1931 | AGACCUAC G GAUGGCA | 3739 | UGCCAUCC GGAGGAAACUCC CU UCAAGGACAUCGUCCGGG GUAGGUCU | 4223 |
| 1932 | GACCUACG G AUGGCAU | 3740 | AUGCCAUC GGAGGAAACUCC CU UCAAGGACAUCGUCCGGG CGUAGGUC | 4224 |
| 1933 | ACCUACGG G AUGGCAUC | 3741 | GAUGCCAU GGAGGAAACUCC CU UCAAGGACAUCGUCCGGG CCGUAGGU | 4225 |
| 1936 | UACGGGAU G GCAUCAUC | 3742 | GAUGAUGC GGAGGAAACUCC CU UCAAGGACAUCGUCCGGG AUCCCGUA | 4226 |
| 1937 | ACGGGAUG G CAUCAUCU | 2370 | AGAUGAUG GGAGGAAACUCC CU UCAAGGACAUCGUCCGGG CAUCCCGU | 4227 |
| 1948 | UCAUCUCA G AUAUAUUU | 3743 | AAAUAUAU GGAGGAAACUCC CU UCAAGGACAUCGUCCGGG UGAGAUGA | 4228 |
| 1957 | AUAUAUUU G AUAAAAA | 3744 | UUUUUAU GGAGGAAACUCC CU UCAAGGACAUCGUCCGGG AAAUAUAU | 4229 |
| 1966 | AUAAAAAA G AAAAAACU | 3745 | AGUUUUUU GGAGGAAACUCC CU UCAAGGACAUCGUCCGGG UUUUUUAU | 4230 |
| 1983 | CUUCUACA G AAAUUACU | 3746 | AGUAAUUU GGAGGAAACUCC CU UCAAGGACAUCGUCCGGG UGUAGAAG | 4231 |
| 1998 | CUCUCAAA G AAACCUGA | 3747 | UCAGGUUU GGAGGAAACUCC CU UCAAGGACAUCGUCCGGG UUUGAGAG | 4232 |
| 2005 | AGAAACCU G AGGAUCCA | 3748 | UCGAUCCU GGAGGAAACUCC CU UCAAGGACAUCGUCCGGG AGGUUUCU | 4233 |
| 2007 | AAACCUGA G GAUCGACC | 3749 | GGUCGAUC GGAGGAAACUCC CU UCAAGGACAUCGUCCGGG UCAGGUUU | 4234 |
| 2008 | AACCUGAG G AUCCACCU | 3750 | ACGUCGAU GGAGGAAACUCC CU UCAAGGACAUCGUCCGGG CUCAGGUU | 4235 |
| 2012 | UGAGGAUC G ACCUAACA | 3751 | UGUUAGGU GGAGGAAACUCC CU UCAAGGACAUCGUCCGGG GAUCCUCA | 4236 |
| 2026 | ACACAUCU G AAAUACUA | 3752 | UAGUAUUU GGAGGAAACUCC CU UCAAGGACAUCGUCCGGG AGAUGUGU | 4237 |
| 2036 | AAUACUAA G GACCUUGA | 3753 | UCAAGGUC GGAGGAAACUCC CU UCAAGGACAUCGUCCGGG UUAGUAUU | 4238 |
| 2037 | AUACUAAG G ACCUUGAC | 3754 | GUCAAGGU GGAGGAAACUCC CU UCAAGGACAUCGUCCGGG CUUAGUAU | 4239 |
| 2043 | AGGACCUU G ACUGUGUG | 3755 | CACACAGU GGAGGAAACUCC CU UCAAGGACAUCGUCCGGG AAGGUCCU | 4240 |
| 2047 | CCUUGACU G UGUGGAAG | 2371 | CUUCCACA GGAGGAAACUCC CU UCAAGGACAUCGUCCGGG AGUCAAGG | 4241 |
| 2049 | UUGACUGU G UGGAAGAA | 2372 | UUCUUCCA GGAGGAAACUCC CU UCAAGGACAUCGUCCGGG ACAGUCAA | 4242 |
| 2051 | GACUGUGU G GAAGAAAA | 3756 | UUUUCUUC GGAGGAAACUCC CU UCAAGGACAUCGUCCGGG ACACAGUC | 4243 |
| 2052 | ACUGUGUG G AAGAAAAG | 3757 | CUUUUCUU GGAGGAAACUCC CU UCAAGGACAUCGUCCGGG CACACAGU | 4244 |
| 2055 | GUGUGGAA G AAAAGCCC | 3758 | GGGCUUUU GGAGGAAACUCC CU UCAAGGACAUCGUCCGGG UUCCACAC | 4245 |
| 2060 | GAAGAAAA G CCCAGAGA | 2373 | UCUCUGGG GGAGGAAACUCC CU UCAAGGACAUCGUCCGGG UUUUCUUC | 4246 |
| 2065 | AAAGCCCA G AGAAAAU | 3759 | AUUUUUCU GGAGGAAACUCC CU UCAAGGACAUCGUCCGGG UGGGCUUU | 4247 |
| 2067 | AGCCCAGA G AAAAAUGA | 3760 | UCAUUUUU GGAGGAAACUCC CU UCAAGGACAUCGUCCGGG UCUGGGCU | 4248 |
| 2074 | AGAAAAAU G AACGACAC | 3761 | GUGUCGUU GGAGGAAACUCC CU UCAAGGACAUCGUCCGGG AUUUUUCU | 4249 |
| 2078 | AAAUGAAC G ACACACAU | 3762 | AUGUGUGU GGAGGAAACUCC CU UCAAGGACAUCGUCCGGG GUUCAUUU | 4250 |
| 2087 | ACACACAU G UUAGAGCC | 2374 | GGCUCUAA GGAGGAAACUCC CU UCAAGGACAUCGUCCGGG AUGUGUGU | 4251 |
| 2091 | ACAUGUUA G AGCCCUUC | 3763 | GAAGGGCU GGAGGAAACUCC CU UCAAGGACAUCGUCCGGG UAACAUGU | 4252 |
| 2093 | AUGUUAGA G CCCUUCUG | 2375 | CAGAAGGG GGAGGAAACUCC CU UCAAGGACAUCGUCCGGG UCUAACAU | 4253 |
| 2101 | GCCCUUCU G AAAAGUA | 3764 | UACUUUUU GGAGGAAACUCC CU UCAAGGACAUCGUCCGGG AGAAGGGC | 4254 |
| 2107 | CUGAAAAA G UAUCCGC | 2376 | GCAGGAUA GGAGGAAACUCC CU UCAAGGACAUCGUCCGGG UUUUUCAG | 4255 |
| 2114 | AGUAUCCU G CUUCUGAU | 2377 | AUCAGAAG GGAGGAAACUCC CU UCAAGGACAUCGUCCGGG AGGAUACU | 4256 |
| 2120 | CUGCUUCU G AUAUGCAG | 3765 | CUGCAUAU GGAGGAAACUCC CU UCAAGGACAUCGUCCGGG AGAAGCAG | 4257 |
| 2125 | UCUGAUAU G CAGUUUUC | 2378 | GAAAACUG GGAGGAAACUCC CU UCAAGGACAUCGUCCGGG AUAUCAGA | 4258 |
| 2128 | GAUAUGCA G UUUCCUU | 2379 | AAGGAAAA GGAGGAAACUCC CU UCAAGGACAUCGUCCGGG UGCAUAUC | 4259 |
| 2153 | UAAAAUCU G CUAGGGAA | 2380 | UUCCCUAC GGAGGAAACUCC CU UCAAGGACAUCGUCCGGG AGAUUUUA | 4260 |
| 2157 | AUCUGCUA G GAAUAUC | 3766 | GAUAUUCC GGAGGAAACUCC CU UCAAGGACAUCGUCCGGG UAGCACAU | 4261 |
| 2158 | UCUGCUAC G GAAUAUCA | 3767 | UGAUAUUC GGAGGAAACUCC CU UCAAGGACAUCGUCCGGG CUAGCAGA | 4262 |
| 2159 | CUGCUAGG G AAUAUCAA | 3768 | UUGAUAUU GGAGGAAACUCC CU UCAAGGACAUCGUCCGGG CCUAGCAG | 4263 |
| 2170 | UAUCAUA G AUAUUUAC | 3769 | GUAAAUAU GGAGGAAACUCC CU UCAAGGACAUCGUCCGGG UAUUGAUA | 4264 |
| 2192 | AUUUUAAU G UUUCCUUU | 2381 | AAAGGAAA GGAGGAAACUCC CU UCAAGGACAUCGUCCGGG AUUAAAAU | 4265 |
| 2230 | AUCUUUCU G CAGAAGAU | 2382 | UGUUUCUG GGAGGAAACUCC CU UCAAGGACAUCGUCCGGG AGAAAGAU | 4266 |
| 2233 | UUUCUGCA G AAACAGAA | 3770 | UUCUGUUU GGAGGAAACUCC CU UCAAGGACAUCGUCCGGG UGCAGAAA | 4267 |
| 2239 | CAGAAACA G AAAGGUUU | 3771 | AAACCUUU GGAGGAAACUCC CU UCAAGGACAUCGUCCGGG UGUUUCUG | 4268 |
| 2243 | AAGAGAAA G GUUUCUU | 3772 | AAGAAAAC GGAGGAAACUCC CU UCAAGGACAUCGUCCGGG UUUCUGUU | 4269 |
| 2244 | ACAGAAAC G UUUUCUUC | 2383 | GAAGAAAA GGAGGAAACUCC CU UCAAGGACAUCGUCCGGG CUUUCUGU | 4270 |
| 2258 | UUCUUUUU G CUUCAAAA | 2384 | UUUUGAAG GGAGGAAACUCC CU UCAAGGACAUCGUCCGGG AAAAAGAA | 4271 |
| 2292 | UUUUCCU G GCUCAUCU | 3773 | AGAUGAGC GGAGGAAACUCC CU UCAAGGACAUCGUCCGGG AGGAAAAA | 4272 |
| 2293 | UUUUCCUG G CUCAUCUC | 2385 | GAGAUGAG GGAGGAAACUCC CU UCAAGGACAUCGUCCGGG CAGGAAAA | 4273 |
| 2326 | UUUUUAAA G ACAGAGUC | 3774 | GACUCUGU GGAGGAAACUCC CU UCAAGGACAUCGUCCGGG UUUAAAAA | 4274 |
| 2330 | UAAAGACA G AGUCUCGC | 3775 | CGCAGACU GGAGGAAACUCC CU UCAAGGACAUCGUCCGGG UGUCUUUA | 4275 |

TABLE XII-continued

Human PKR Amberzyme and Substrate Sequence

| Pos | Substrate | | | Seq ID | Amberzyme | | | Seq ID |
|---|---|---|---|---|---|---|---|---|
| 2332 | AAGACAGA | G | UCUCGCUC | 2386 | GAGCGAGA | GGAGGAAACUCC CU UCAAGGACAUCGUCCGGG | UCUGUCUU | 4276 |
| 2337 | ACAGUCUC | G | CUCUGUUG | 2387 | CAACAGAG | GGAGGAAACUCC CU UCAAGGACAUCGUCCGGG | GAGACUCU | 4277 |
| 2342 | CUCGCUCU | G | UUGCCCAG | 2388 | CUGGGCAA | GGAGGAAACUCC CU UCAAGGACAUCGUCCGGG | AGAGCGAG | 4278 |
| 2345 | GCUCUGUU | G | CCCAGGCU | 2389 | AUCCUGGG | GGAGGAAACUCC CU UCAAGGACAUCGUCCGGG | AACAGAGC | 4279 |
| 2350 | GUUGCCCA | G | GCUGGAGU | 3776 | ACUCCAGC | GGAGGAAACUCC CU UCAAGGACAUCGUCCGGG | UGGGCAAC | 4280 |
| 2351 | UUGCCCAG | G | CUGGAGUG | 2390 | CACUCCAG | GGAGGAAACUCC CU UCAAGGACAUCGUCCGGG | CUGGGCAA | 4281 |
| 2354 | CCCAGGCU | G | GAGUGCAA | 3777 | UUGCACUC | GGAGGAAACUCC CU UCAAGGACAUCGUCCGGG | AGCCUGGG | 4282 |
| 2355 | CCAGGCUG | G | AGUGCAAU | 3778 | AUUGCACU | GGAGGAAACUCC CU UCAAGGACAUCGUCCGGG | CAGCCUGG | 4283 |
| 2357 | AGGCUGGA | G | UGCAAUGA | 2391 | UCAUUGCA | GGAGGAAACUCC CU UCAAGGACAUCGUCCGGG | UCCAGCCU | 4284 |
| 2359 | GCUGGAGU | G | CAAUGACA | 2392 | UGUCAUUG | GGAGGAAACUCC CU UCAAGGACAUCGUCCGGG | ACUCCAGC | 4285 |
| 2364 | AGUGCAAU | G | ACACAGUC | 3779 | GACUGUGU | GGAGGAAACUCC CU UCAAGGACAUCGUCCGGG | AUUGCACU | 4286 |
| 2370 | AUGACACA | G | UCUUGGCU | 2393 | AGCCAAGA | GGAGGAAACUCC CU UCAAGGACAUCGUCCGGG | UGUGUCAU | 4287 |
| 2375 | ACAGUCUU | G | GCUCACUG | 3780 | CAGUGAGC | GGAGGAAACUCC CU UCAAGGACAUCGUCCGGG | AAGACUGU | 4288 |
| 2376 | CAGUCUUG | G | CUCACUGC | 2394 | GCAGUGAG | GGAGGAAACUCC CU UCAAGGACAUCGUCCGGG | CAAGACUG | 4289 |
| 2383 | GGCUCACU | G | CAACUUCU | 2395 | AGAAGUUG | GGAGGAAACUCC CU UCAAGGACAUCGUCCGGG | AGUGAGCC | 4290 |
| 2392 | CAACUUCU | G | CCUCUUGG | 2396 | CCAAGAGG | GGAGGAAACUCC CU UCAAGGACAUCGUCCGGG | AGAAGUUG | 4291 |
| 2399 | UGCCUCUU | G | GGUUCAAG | 3781 | CUUGAACC | GGAGGAAACUCC CU UCAAGGACAUCGUCCGGG | AAGAGGCA | 4292 |
| 2400 | GCCUCUUG | G | GUUCAAGU | 3782 | ACUUGAAC | GGAGGAAACUCC CU UCAAGGACAUCGUCCGGG | CAAGAGGC | 4293 |
| 2401 | CCUCUUGG | G | UUCAAGUG | 2397 | CACUUGAA | GGAGGAAACUCC CU UCAAGGACAUCGUCCGGG | CCAAGAGG | 4294 |
| 2407 | GGGUUCAA | G | UGAUUCUC | 2398 | GAGAAUCA | GGAGGAAACUCC CU UCAAGGACAUCGUCCGGG | UUGAACCC | 4295 |
| 2409 | GUUCAAGU | G | AUUCUCCU | 3783 | AGGAGAAU | GGAGGAAACUCC CU UCAAGGACAUCGUCCGGG | ACUUGAAC | 4296 |
| 2418 | AUUCUCCU | G | CCUCAGCC | 2399 | GGCUGAGG | GGAGGAAACUCC CU UCAAGGACAUCGUCCGGG | AGGAGAAU | 4297 |
| 2424 | CUGCCUCA | G | CCUCCUGA | 2400 | UCAGGAGG | GGAGGAAACUCC CU UCAAGGACAUCGUCCGGG | UGAGGCAG | 4298 |
| 2431 | AGCCUCCU | G | AGUAGCUG | 3784 | CAGCUACU | GGAGGAAACUCC CU UCAAGGACAUCGUCCGGG | AGGAGGCU | 4299 |
| 2433 | CCUCCUGA | G | UAGCUGGA | 2401 | UCCAGCUA | GGAGGAAACUCC CU UCAAGGACAUCGUCCGGG | UCAGGAGG | 4300 |
| 2436 | CCUGAGUA | G | CUGGAUUA | 2402 | UAAUCCAG | GGAGGAAACUCC CU UCAAGGACAUCGUCCGGG | UACUCAGG | 4301 |
| 2439 | GAGUAGCU | G | GAUUACAG | 3785 | CUGUAAUC | GGAGGAAACUCC CU UCAAGGACAUCGUCCGGG | AUCUACUC | 4302 |
| 2440 | AGUACCUG | G | AUUACAGG | 3786 | CCUGUAAU | GGAGGAAACUCC CU UCAAGGACAUCGUCCGGG | CAGCUACU | 4303 |
| 2447 | GGAUUACA | G | GCAUGUGC | 3787 | GCACAUGC | GGAGGAAACUCC CU UCAAGGACAUCGUCCGGG | UGUAAUCC | 4304 |
| 2448 | GAUUACAG | G | CAUGUGCC | 2403 | GGCACAUG | GGAGGAAACUCC CU UCAAGGACAUCGUCCGGG | CUGUAAUC | 4305 |
| 2452 | ACAGGCAU | G | UGCCACCC | 2404 | GGGUGGCA | GGAGGAAACUCC CU UCAAGGACAUCGUCCGGG | AUGCCUGU | 4306 |
| 2454 | AGGCAUGU | G | CCACCCAC | 2405 | GUGGGUGG | GGAGGAAACUCC CU UCAAGGACAUCGUCCGGG | ACAUGCCU | 4307 |
| 2476 | UAAUUUUU | G | UGUUUUUA | 2406 | UAAAAACA | GGAGGAAACUCC CU UCAAGGACAUCGUCCGGG | AAAAAUUA | 4308 |
| 2478 | AUUUUUGU | G | UUUUUAAU | 2407 | AUUAAAAA | GGAGGAAACUCC CU UCAAGGACAUCGUCCGGG | ACAAAAAU | 4309 |
| 2490 | UUAAUAAA | G | ACAGGGUU | 3788 | AACCCUGU | GGAGGAAACUCC CU UCAAGGACAUCGUCCGGG | UUUAUUAA | 4310 |
| 2494 | UAAAGACA | G | GGUUUCAC | 3789 | GUGAAACC | GGAGGAAACUCC CU UCAAGGACAUCGUCCGGG | UGUCUUUA | 4311 |
| 2495 | AAAGACAG | G | GUUUCACC | 3790 | GGUGAAAC | GGAGGAAACUCC CU UCAAGGACAUCGUCCGGG | CUGUCUUU | 4312 |
| 2496 | AAGACAGG | G | UUUCACCA | 2408 | UGGUGAAA | GGAGGAAACUCC CU UCAAGGACAUCGUCCGGG | CCUGUCUU | 4313 |
| 2506 | UUCACCAU | G | UUGGCCAG | 2409 | CUGGCCAA | GGAGGAAACUCC CU UCAAGGACAUCGUCCGGG | AUGGUGAA | 4314 |
| 2509 | ACCAUGUU | G | GCCAGGCU | 3791 | AGCCUGGC | GGAGGAAACUCC CU UCAAGGACAUCGUCCGGG | AACAUGGU | 4315 |
| 2510 | CCAUGUUG | G | CCAGGCUC | 2410 | CAGCCUGG | GGAGGAAACUCC CU UCAAGGACAUCGUCCGGG | CAACAUGG | 4316 |
| 2514 | GUUGGCCA | G | GCUGGUCU | 3792 | AGACCAGC | GGAGGAAACUCC CU UCAAGGACAUCGUCCGGG | UGGCCAAC | 4317 |
| 2515 | UUGGCCAG | G | CUGGUCUC | 2411 | GAGACCAG | GGAGGAAACUCC CU UCAAGGACAUCGUCCGGG | CUGGCCAA | 4318 |
| 2518 | GCCAGGCU | G | GUCUCAAA | 3793 | UUUGAGAC | GGAGGAAACUCC CU UCAAGGACAUCGUCCGGG | AGCCUGGC | 4319 |
| 2519 | CCAGGCUG | G | UCUCAAAC | 2412 | GUUUGAGA | GGAGGAAACUCC CU UCAAGGACAUCGUCCGGG | CAGCCUGG | 4320 |
| 2532 | AAACUCCU | G | ACCUCAAG | 2794 | CUUGAGGU | GGAGGAAACUCC CU UCAAGGACAUCGUCCGGG | AGGAGUUU | 4321 |
| 2540 | GACCUCAA | G | UAAUCCAC | 2413 | GUGGAUUA | GGAGGAAACUCC CU UCAAGGACAUCGUCCGGG | UUGAGGUC | 4322 |
| 2551 | AUCCACCU | G | CCUCGGCC | 2414 | GGCCGAGG | GGAGGAAACUCC CU UCAAGGACAUCGUCCGGG | AGGUGGAU | 4323 |
| 2556 | CCUGCCUC | G | GCCUCCCA | 3795 | UGGGAGGC | GGAGGAAACUCC CU UCAAGGACAUCGUCCGGG | GAGGCAGG | 4324 |
| 2557 | CUGCCUCG | G | CCUCCCAA | 2415 | UUGGGAGG | GGAGGAAACUCC CU UCAAGGACAUCGUCCGGG | CGAGGCAG | 4325 |
| 2567 | CUCCCAAA | G | UGCUGGGA | 2416 | UCCCAGCA | GGAGGAAACUCC CU UCAAGGACAUCGUCCGGG | UUUGGGAG | 4326 |
| 2569 | CCCAAGU | G | CUGGGAUU | 2417 | AAUCCCAG | GGAGGAAACUCC CU UCAAGGACAUCGUCCGGG | ACUUGGG | 4327 |
| 2572 | AAAGUGCU | G | GGAUUACA | 3796 | UGUAAUCC | GGAGGAAACUCC CU UCAAGGACAUCGUCCGGG | AGCACUUU | 4328 |
| 2573 | AAGUGCUG | G | GAUUACAG | 3797 | CUGUAAUC | GGAGGAAACUCC CU UCAAGGACAUCGUCCGGG | CAGCACUU | 4329 |
| 2574 | AGUGCUGG | G | AUUACAGG | 3798 | CCUGUAAU | GGAGGAAACUCC CU UCAAGGACAUCGUCCGGG | CCAGCACU | 4330 |
| 2581 | GGAUUACA | G | GAUGAGCC | 3799 | GCUCAUCC | GGAGGAAACUCC CU UCAAGGACAUCGUCCGGG | UGUAAUCC | 4331 |
| 2582 | GAUUACAG | G | GAUGAGCC | 3800 | GGCUCAUC | GGAGGAAACUCC CU UCAAGGACAUCGUCCGGG | CUGUAAUC | 4332 |
| 2583 | AUUACAGG | G | AUGAGCCA | 3801 | UGGCUCAU | GGAGGAAACUCC CU UCAAGGACAUCGUCCGGG | CCUGUAAU | 4333 |
| 2586 | ACAGGGAU | G | AGCCACCG | 3802 | CGGUGGCU | GGAGGAAACUCC CU UCAAGGACAUCGUCCGGG | AUCCCUGU | 4334 |
| 2588 | AGGGAUGA | G | CCACCGCG | 2418 | CGCGGUGG | GGAGGAAACUCC CU UCAAGGACAUCGUCCGGG | UCAUCCCU | 4335 |
| 2594 | GAGCCACC | G | CGCCCACC | 2419 | GCUGGGCG | GGAGGAAACUCC CU UCAAGGACAUCGUCCGGG | GGUGGCUC | 4336 |
| 2596 | GCCACCGC | G | CCCAGCCU | 2420 | AGGCUGGG | GGAGGAAACUCC CU UCAAGGACAUCGUCCGGG | GCGUGGCG | 4337 |
| 2601 | CGCGCCCA | G | CCUCUCU | 2421 | AGAUGAGG | GGAGGAAACUCC CU UCAAGGACAUCGUCCGGG | UGGGCGCG | 4338 |
| 2614 | AUCUCUUU | G | UUCUAAAG | 2422 | CUUUAGAA | GGAGGAAACUCC CU UCAAGGACAUCGUCCGGG | AAAGAGAU | 4339 |
| 2622 | CUUCUAAA | G | AUGCAAAA | 3803 | UUUUCCAU | GGAGGAAACUCC CU UCAAGGACAUCGUCCGGG | UUUAGAAC | 4340 |
| 2625 | CUAAAGAU | G | CAAAAACC | 3804 | GGUUUUUC | GGAGGAAACUCC CU UCAAGGACAUCGUCCGGG | AUCUUUAG | 4341 |
| 2626 | UAAAGAUC | G | AAAAACCA | 3805 | UGGUUUUU | GGAGGAAACUCC CU UCAAGGACAUCGUCCGGG | CAUCUUUA | 4342 |
| 2664 | CUAUUAAU | G | AAUCAAUC | 3806 | GAUUCAUU | GGAGGAAACUCC CU UCAAGGACAUCGUCCGGG | AUUAAUAC | 4343 |
| 2702 | UUUCUACC | G | CUUUUAGG | 2423 | CCUAAAAG | GGAGGAAACUCC CU UCAAGGACAUCGUCCGGG | GGUAGAAA | 4344 |
| 2709 | CGCUUUUA | G | GCCAAAAA | 3807 | UUUUUGGC | GGAGGAAACUCC CU UCAAGGACAUCGUCCGGG | UAAAAGCG | 4345 |
| 2710 | GCUUUUAG | G | CCAAAAAA | 2424 | UUUUUUGG | GGAGGAAACUCC CU UCAAGGACAUCGUCCGGG | CUAAAAGC | 4346 |
| 2721 | AAAAAAAU | G | UAAGAUCG | 2425 | CGAUCUUA | GGAGGAAACUCC CU UCAAGGACAUCGUCCGGG | AUUUUUUU | 4347 |
| 2725 | AAAUGUAA | G | AUCGUUCU | 3808 | AGAACGAU | GGAGGAAACUCC CU UCAAGGACAUCGUCCGGG | UUACAUUU | 4348 |
| 2729 | GUAAGAUC | G | UUCUCGC | 2426 | GCAGAGAA | GGAGGAAACUCC CU UCAAGGACAUCGUCCGGG | GAUCUUAC | 4349 |
| 2736 | CGUUCUCU | G | CCUCACAU | 2427 | AUGUGAGG | GGAGGAAACUCC CU UCAAGGACAUCGUCCGGG | AGAGAACG | 4350 |

TABLE XII-continued

Human PKR Amberzyme and Substrate Sequence

| Pos | Substrate | Seq ID | Amberzyme | Seq ID |
|---|---|---|---|---|
| 2746 | CUCACAUA G CUUACAAG | 2428 | CUUGUAAG GGAGGAAACUCC CU UCAAGGACAUCGUCCGGG UAUGUGAG | 4351 |
| 2754 | GCUUACAA G CCAGCUGG | 2429 | CCAGCUGG GGAGGAAACUCC CU UCAAGGACAUCGUCCGGG UUGUAAGC | 4352 |
| 2758 | ACAAGCCA G CUGGAGAA | 2430 | UUCUCCAG GGAGGAAACUCC CU UCAAGGACAUCGUCCGGG UGGCUUGU | 4353 |
| 2761 | AGCCAGCU G GAGAAAUA | 3809 | UAUUUCU GGAGGAAACUCC CU UCAAGGACAUCGUCCGGG AGCUGGCU | 4354 |
| 2762 | GCCAGCUG G AGAAAUAU | 3810 | AUAUUUCU GGAGGAAACUCC CU UCAAGGACAUCGUCCGGG CAGCUGGC | 4355 |
| 2764 | CAGCUGGA G AAAUAUGG | 3811 | CCAUAUUU GGAGGAAACUCC CU UCAAGGACAUCGUCCGGG UCCAGCUG | 4356 |
| 2771 | AGAAAUAU G UACUCAU | 3812 | AUGAGUAC GGAGGAAACUCC CU UCAAGGACAUCGUCCGGG AUAUUUCU | 4357 |
| 2772 | GAAAUAUG U UACUCAUU | 2431 | AAUGAGUA GGAGGAAACUCC CU UCAAGGACAUCGUCCGGG CAUAUUUC | 4358 |
| 2796 | AAAAAAAA G UGAUGUAC | 2432 | GGACAUCA GGAGGAAACUCC CU UCAAGGACAUCGUCCGGG UUUUUUUU | 4359 |
| 2798 | AAAAAAGU G AUGUACAA | 3813 | UUGUACAU GGAGGAAACUCC CU UCAAGGACAUCGUCCGGG ACUUUUUU | 4360 |

Input Sequence = NM_002759. Cut Site = G/.
Arm Length = 8. Core Sequence = GGAGGAAACUCC CU UCAAGGACAUCGUCCGGG NM_002759 (Homo sapiens protein kinase, interferon-inducible double stranded RNA dependent (PRKR), mRNA.; 2808 bp)

TABLE XIII

Human IKK-gamma and PKR Nucleic Acid and Target molecules

| Gene | Pos | Target | Seq ID | RPI# | Enzymatic Nucleic Acid | Seq ID |
|---|---|---|---|---|---|---|
| PKR | 563 | UUUACAUUUCAAGUU | 7771 | 24072 | $a_s a_s c_s u_s$guacUGauGaggccguuaggccGaaAuguaaaB | 7884 |
| PKR | 571 | UCAAGUUAUAAUAGA | 7772 | 24073 | $u_s c_s u_s a_s$uuacUGAuGaggccguuaggccGaaAacuugaB | 7885 |
| PKR | 644 | GCCAAAUUAGCUGUU | 7773 | 24074 | $a_s a_s c_s a_s$gcucUGAuGaggccguuaggccGaaAuuuggcB | 7886 |
| PKR | 645 | CCAAAUUAGCUGUUG | 7774 | 24075 | $c_s a_s a_s c_s$agccUGAuGaggccguuaggccGaaAauuuggB | 7887 |
| PKR | 1259 | UUGGCUCAGGUGG | 7775 | 24076 | $c_s c_s a_s c_s$cucUGAuGaggccguuaggccGaaAgccaaB | 7888 |
| PKR | 1259 | AUUGGCUCAGGUGGA | 7776 | 24077 | $u_s c_s c_s a_s$cccuUGAuGaggccguuaggccGaaAgccaauB | 7889 |
| PKR | 1538 | UGGAAUUCUGUGA | 7777 | 24078 | $u_s c_s a_s$agcUGAuGaggccguuaggccGaaAuuccaB | 7890 |
| PKR | 1538 | AUGGAAUUCUGUGAU | 7778 | 24079 | $a_s u_s c_s a_s$cagcUGAuGaggccguuaggccGaaAuuccauB | 7891 |
| PKR | 1678 | AGAGAUCUUAAGC | 7779 | 24080 | $g_s c_s u_s$aacUGAuGaggccguuaggccgaaAucucuB | 7892 |
| PKR | control | GACGAUUGCAAUC | 7780 | 24081 | $g_s a_s u_s$gcUGAuGacgccguuaggcgGaaAucgucB | 7893 |
| PKR | control | ACACCGUUGGAUCGC | 7781 | 24082 | $g_s c_s g_s a_s$uccUAGuGacgccguuaggcgGaaAlcguguB | 7894 |
| PKR | 764 | UUGCCCAGAAGAA | 7782 | 24153 | $u_s c_s u_s$uccUGAuGaggccguuaggccGaaAlgcaaB | 7895 |
| PKR | 1540 | GGAAUUCUGUGAUAA | 7783 | 24154 | $u_s u_s a_s u_s$caccUGAuGaggccguuaggccGaaAlaauuccB | 7896 |
| PKR | 1679 | GAGAUCUUAAGCC | 7784 | 24155 | $g_s c_s u_s$acUGAuGaggccguuaggccGaaAlaucucB | 7897 |
| PKR | 1679 | AGAGAUCUUAAGCCA | 7785 | 24156 | $u_s g_s c_s$uuacUGAuGaggccguuaggccGaaAlaucucuB | 7898 |
| PKR | Control | AGUGGCAUACAUG | 7786 | 24157 | $c_s a_s u_s g_s$uacUAGuGacgccguuaggcgGaaAlccaguB | 7899 |
| PKR | Control | CAUUCGCUAAAUGAG | 7787 | 24158 | $c_s u_s c_s a_s$uuucUAGuGacgccguuaggcgGaaAlcgaaugB | 7900 |
| PKR | 1348 | GAGAAGGCGGAGC | 7788 | 24210 | $g_s c_s u_s c_s$cggccgaaaggCgagugaGguCucuucucB | 7901 |
| PKR | Control | CCGUACGUUAAGA | 7789 | 24211 | $u_s c_s u_s u_s$aagccgaaaggCuCugGagugaggguacggB | 7902 |
| PKR | Control | ACGAAGAGUUACCUU | 7790 | 24212 | $a_s a_s g_s g_s$uaagccgaaaggCuCugGagugagucuucguB | 7903 |
| PKR | 1224 | AGAGGUUUGGCAUGG | 7791 | 24416 | ccaugccCUGAUGAggccguuaggccGAAAaccucuB | 7904 |
| PKR | 1556 | GGGACCUUGGAACAA | 7792 | 24417 | uuguuccCUGAUGAggccguuaggccGAAAgguccB | 7905 |
| PKR | 1780 | AAGGAGUAAGGGAAC | 7793 | 24418 | guucccuCUGAUGAggccguuaggccGAAAcuccuuB | 7906 |
| PKR | 2296 | CCUGGCUCAUCUCUU | 7794 | 24419 | aagagauCUGAUGAggccguuaggccGAAAagcaggB | 7907 |
| PKR | 2732 | GAUCGUUCUCUGCCU | 7795 | 24420 | aggcagaCUGAUGAggccguuaggccGAAAacgaucB | 7908 |
| PKR | 198 | UACUCGCUAGUGUCA | 7796 | 24421 | gacagacCUGAUGAggccguuaggccGAAIcgaguaB | 7909 |
| PKR | 322 | GCAGUUCUUCCAUCU | 7797 | 24422 | agaugaCUGAUGAggccguuaggccGAAIaacugcB | 7910 |
| PKR | 1805 | AUGAGCCCAGAACAG | 7798 | 24423 | cuguucuCUGAUGAggccguuaggccGAAIgcucauB | 7911 |
| PKR | 2297 | CUGGCUCAUCUCUUU | 7799 | 24424 | aaagagaCUGAUGAggccguuaggccGAAIagccagB | 7912 |
| PKR | 2733 | AUCGUUCUCUGCCUC | 7800 | 24425 | gaggcagCUGAUGAggccguuaggccGAAIaacgauB | 7913 |
| PKR | 199 | ACUCGCUAGUGUCA | 7801 | 24426 | ugacagagccgaaaggCgagugaGguCuagcgaguB | 7914 |
| PKR | 810 | CGGGGGUGCAUGGGC | 7802 | 24427 | gcccaugccgaaaggCgagugaGGuCuaccccgB | 7915 |
| PKR | 904 | ACAAUUGCCGCUAA | 7803 | 24428 | uuagcgggccgaaaggCgagugaGGuCucaauuguB | 7916 |
| PKR | 966 | ACUACCUGUCCUCUG | 7804 | 24429 | cagaggagccgaaaggCgagugaGGuCuaggguaguB | 7917 |
| PKR | 992 | ACUACGUGAGUCC | 7805 | 24430 | ggacucagccgaaaggCgagugaGGuCuacguaguB | 7918 |
| PKR | 396 | UGCGUGCAUUUUGGA | 7806 | 24431 | uccaaaaGGCUAGCUACAACGAgcacgCaB | 7919 |
| PKR | 966 | ACUACCUGUCCUCUG | 7804 | 24432 | cagaggaGGCUAGCUACAACGAagguaguB | 7920 |
| PKR | 1563 | UGGAACAAUGGAUUG | 7807 | 24433 | caauccuGGCUAGCUACAACGAuguuccaB | 7921 |
| PKR | 2297 | CUGGCUCAUCUCUUU | 7799 | 24434 | aaagagaGGCUAGCUACAACGAgagccagB | 7922 |
| PKR | 2543 | UCAAGUAAUCCACCU | 7808 | 24435 | agguggaGGCUAGCUACAACGAuacuugaB | 7923 |
| PKR | 604 | AGGUGAAGGUAGAUC | 7809 | 24436 | gaucuacGgaggaaacucCCUUCaaggacaucgucCGGGuucaccuB | 7924 |
| PKR | 903 | AACAAUUGGCCGCUA | 7810 | 24437 | uagcggcGgaggaaacucCCUUCaaggacaucgucCGGGaauuguuB | 7925 |
| PKR | 966 | ACUACCUGUCCUCUG | 7804 | 24438 | cagaggaGgaggaaacucCCUUCaaggacaucgucCGGGagguaguB | 7926 |
| PKR | 1186 | CCUUCCUGACAUGAA | 7811 | 24439 | uucauguGgaggaaacucCCUUCaaggacaucgucCGGGagguaaggB | 7927 |
| PKR | 2292 | UUUUCCUGGCUCAUC | 7812 | 24440 | gaugagcGgaggaaacucCCUUCaaggacaucgucCGGGaggaaaaB | 7928 |
| IKKg | 427 | AGUUCCUCAUGUGCA | 7813 | 24083 | $u_s g_s c_s a_s$caucUGAuGaggccguuaggccGaaAggaacuB | 7929 |
| IKKg | 1067 | GCGGAUACUACA | 7814 | 24084 | $u_s g_s u_s a_s$gacUGAuGaggccguuaggccGaaAuccgcB | 7930 |
| IKKg | 1067 | GGCGGAUAUCUACAA | 7815 | 24085 | $u_s u_s g_s u_s$gacUGAuGaggccguuaggccGaaAuccgccB | 7931 |
| IKKg | 1069 | CGGAUAUCUACAAGG | 7816 | 24086 | $c_s c_s u_s u_s$guacUGAuGaggccguuaggccGaaAuauccgB | 7932 |
| IKKg | 1071 | AUAUCUACAAGGC | 7817 | 24087 | $g_s c_s c_s u_s$ugcUGAuGaggccguuaggccGaaAgauauB | 7933 |
| IKKg | 1390 | UACAUGUCAUGGAGU | 7818 | 24088 | $a_s c_s u_s c_s$caucUGAuGaggccguuaggccGaaAcauguaB | 7934 |
| IKKg | 1402 | AGUGCAUUGAGUAGG | 7819 | 24089 | $c_s c_s u_s a_s$cuccUGAuGaggccguuaggccGaaAugcacuB | 7935 |

TABLE XIII-continued

Human IKK-gamma and PKR Nucleic Acid and Target molecules

| Gene | Pos | Target | Seq ID | RPI# | Enzymatic Nucleic Acid | Seq ID |
|---|---|---|---|---|---|---|
| IKKg | control | ACGACUCGGAGCU | 7820 | 24090 | a_sg_sc_su_scccUAGuGacgccguuaggcgGaaAgucguB | 7936 |
| IKKg | control | UCUGAGUCAGGCGAC | 7821 | 24091 | g_su_sc_sg_sccuUAGuGacgccguuaggcgGaaAcucagaB | 7937 |
| IKKg | 195 | UGCAGCCCAGUGG | 7822 | 24159 | c_sc_sa_sc_sugcUGAuGaggccguuaggccGaalcugcaB | 7938 |
| IKKg | 196 | GCAGCCCAGUGGU | 7823 | 24160 | a_sc_sc_sa_scucUGAuGaggccguuaggccGaalgccucB | 7939 |
| IKKg | 303 | CCCUCCAGCGCUG | 7824 | 24161 | c_sa_sg_sc_sgccUGAuGaggccguuaggccGaalgagggB | 7940 |
| IKKg | 324 | AGAAUCAAGAGCU | 7825 | 24162 | a_sg_sc_su_scucUGAuGaggccguuaggccGaalauucuB | 7941 |
| IKKg | 324 | GAGAAUCAAGAGCUC | 7826 | 24163 | g_sa_sg_sc_sucucUGAuGaggccguuaggccGaalauucuB | 7942 |
| IKKg | 556 | GAUGGCUGAGGAC | 7827 | 24164 | g_sg_su_sc_sguccUGAuGaggccguuaggccGaalccaucB | 7943 |
| IKKg | 556 | AGAUGGCUGAGGACA | 7828 | 24165 | u_sg_su_sc_scuccUGAuGaggccguuaggccGaalccaucuB | 7944 |
| IKKg | 568 | ACAAGGCCUCUGUGA | 7829 | 24166 | u_sc_sa_sc_sagacUGAuGaggccguuaggccGaalccuuguB | 7945 |
| IKKg | 571 | GGCCUCUGUGAAA | 7830 | 24167 | u_su_su_sc_saccUGAuGaggccguuaggccGaalaggccB | 7946 |
| IKKg | 580 | UGAAAGCCCAGGUGA | 7831 | 24168 | u_sc_sa_sc_scugcUGAuGaggccguuaggccGaalcuuucaB | 7947 |
| lKKg | 749 | GUGGACCAGCUGC | 7832 | 24169 | g_sc_sa_sg_scucUGAugaggccguuaggccGaaluccacB | 7948 |
| IKKg | 927 | UGCAGCUGGAAGA | 7833 | 24170 | u_sc_su_su_scccUGAuGaggccguuaggccGaalcugcaB | 7949 |
| IKKg | 927 | AUGCAGCUGGAAGAU | 7834 | 24171 | a_su_sc_su_succcUGAuGaggccguuaggccGaalcugcauB | 7950 |
| IKKg | 1012 | GGAGGCCGAGCAG | 7835 | 24172 | c_su_sg_sc_succUGAuGaggccguuaggccGaalccuccB | 7951 |
| IKKg | 1012 | AGGAGGCCGAGCAGC | 7836 | 24173 | g_sc_su_sg_scuccUGAuGaggccguuaggccGaalccuccB | 7952 |
| lKKg | 1020 | AGCAGCACAAGAU | 7837 | 24174 | a_su_sc_su_sugcUGAuGaggccguuaggccGaalcugcuB | 7953 |
| IKKg | 1020 | GAGCAGCACAAGAUU | 7838 | 24175 | a_sa_su_sc_suugcUGAuGaggccguuaggccGaalcugcucB | 7954 |
| IKKg | 1022 | GCAGCACAAGAUUGU | 7839 | 24176 | a_sc_sa_sa_sucucUGAuGaggccguuaggccGaalugcugcB | 7955 |
| IKKg | 1070 | GGAUAUCUACAAGGC | 7840 | 24177 | g_sc_sc_su_succUGAuGaggccguuaggccGaalauauccB | 7956 |
| IKKg | 1143 | AGGAGGAGCUGGA | 7841 | 24178 | u_sc_sc_sa_sgccUGAuGaggccguuaggccGaalcuccuB | 7957 |
| IKKg | 1350 | AAGUGCCAGUAUCAG | 7842 | 24179 | c_su_sg_sa_suaccUGAuGaggccguuaggccGaalgcacuuB | 7958 |
| IKKg | 1391 | CAUGUCAUGGAGU | 7843 | 24180 | a_sc_su_sc_scacUGAuGaggccguuaggccGaalacaugB | 7959 |
| IKKg | 1391 | ACAUGUCAUGGAGUG | 7844 | 24181 | c_sa_sc_su_sccacUGAuGaggccguuaggccGaalacauguB | 7960 |
| IKKg | Control | CACGUCUGCGGAA | 7845 | 24182 | u_su_sc_sc_sgccUAGuGacgccguuaggcgGaalacguguB | 7961 |
| IKKg | Control | UCGGAACCAGGUCUG | 7846 | 24183 | c_sa_sg_sa_sccuUAGuGacgccguuaggcgGaaluuccgaB | 7962 |
| IKKg | 304 | CCCUCCAGCGCUGCC | 7847 | 24213 | g_sg_sc_sa_sgcgccgaaaggCgagugaGguCuuggagggB | 7963 |
| IKKg | 306 | CUCCAGCGCUGCCUG | 7848 | 24214 | c_sa_sg_sg_sca_sgggccgaaaggCgagugaGguCugcuggagB | 7964 |
| IKKg | 309 | AGCGCUGCCUGGA | 7849 | 24215 | u_sc_sc_sa_sgggccgaaaggCgagugaGguCuagcgcuB | 7965 |
| IKKg | 328 | UCAAGAGCUCCGA | 7850 | 24216 | u_sc_sg_sa_saggccgaaaggCgagugaGguCuucuugaB | 7966 |
| IKKg | 328 | AUCAAGAGCUCCGAG | 7851 | 24217 | c_su_sc_sg_sgaggccgaaaggCgagugaGguCuucuugauB | 7967 |
| IKKg | 572 | GCCUCUGUGAAAG | 7852 | 24218 | c_su_su_su_scagccgaaaggCgagugaGguCuagaggcB | 7968 |
| IKKg | 572 | GGCCUCUGUGAAAGC | 7853 | 24219 | g_sc_su_su_sucagccgaaaggCgagugaGguCuagaggccB | 7969 |
| IKKg | 705 | UGGAGAGUGAGCG | 7854 | 24220 | c_sg_sc_su_scagccgaaaggCgagugaGguCuuccucaB | 7970 |
| IKKg | 1028 | CAAGAUUGUGAUGGA | 7855 | 24221 | u_sc_sc_sa_sucagccgaaaggCgagugaGguCuaaucuugB | 7971 |
| IKKg | 1222 | GAGGAAGCGGCAU | 7856 | 24222 | a_su_sg_sc_scggccgaaaggCgagugaGguCuuuccucB | 7972 |
| IKKg | 1222 | UGAGGAAGCGGCAUG | 7857 | 24223 | c_sa_su_sg_sccggccgaaaggCgagugaCguCuuuccucaB | 7973 |
| IKKg | 1351 | AGUGCCAGUAUCAGG | 7858 | 24224 | c_sc_su_sg_sauagccgaaaggCgagugaGguCuuggcacuB | 7974 |
| IKKg | Control | ACUCCGGCUGAGA | 7859 | 24225 | u_sc_su_sa_scggccgaaaggCuCugGagugagcggaguB | 7975 |
| IKKg | Control | GUGACGCGUGUCACA | 7860 | 24226 | u_sg_su_sg_sacagccgaaaggCuCugGagugaggcgucacB | 7976 |
| IKKg | 438 | UGCAAGUUCCAGGAG | 7861 | 24463 | cuccuggCUGAUGAggccguuaggccGAAAcuugcaB | 7977 |
| IKKg | 1167 | AGGGAGUACAGCAAA | 7862 | 24464 | uuugcugCUGAUGAggccguuaggccGAAAcucccuB | 7978 |
| IKKg | 1273 | CCUACCUCUCCUCUC | 7863 | 24465 | gagaggaCUGAUGAggccguuaggccGAAAgguaggB | 7979 |
| IKKg | 1639 | CGCUGCUCUUUUUGU | 7864 | 24466 | acaaaaaCUGAUGAggccguuaggccGAAAgcagcgB | 7980 |
| IKKg | 1781 | GGCAGCUCUUCCUCC | 7865 | 24467 | ggaggaaCUGAUGAggccguuaggccGAAAgcugccB | 7981 |
| IKKg | 741 | AGCGUGCAGGUGGAC | 7866 | 24468 | guccaccCUGAUGAggccguuaggccGAAIcacgcuB | 7982 |
| IKKg | 1158 | CAGCUGCAGAGGGAG | 7867 | 24469 | cucccucCUGAUGAggccguuaggccGAAIcagcugB | 7983 |
| IKKg | 1272 | GCCUACCUCUCCUCU | 7868 | 24470 | agaggagCUGAUGAggccguuaggccGAAIguaggcB | 7984 |
| IKKg | 1650 | UUGUUCCCUUCUGUC | 7869 | 24471 | gacagaaCUGAUGAggccguuaggccGAAIgaacaaB | 7985 |
| IKKg | 1834 | UGCUGCCCUCUUACC | 7870 | 24472 | gguaagaCUGAUGAggccguuaggccGAAIgcagcaB | 7986 |
| IKKg | 52 | CAGAGAAGUGAGGAC | 7871 | 24473 | guccucagccgaaaggCgagugaGGuCuuucucugB | 7987 |
| IKKg | 124 | CAUCGAGGUCCCAUC | 7872 | 24474 | gaugggagccgaaaggCgagugaGGuCucucgaugB | 7988 |
| IKKg | 1338 | UUCUGCUGUCCCAAG | 7873 | 24475 | cuugggagccgaaaggCgagugaGGuCuagcagaaB | 7989 |
| IKKg | 1633 | CUGACUCGCUGCUCU | 7874 | 24476 | agagcaggccgaaaggCgagugaGGuCugagucagB | 7990 |
| IKKg | 1655 | CCCUUCUGUCUGCUC | 7875 | 24477 | gagcagagccgaaaggCgagugaGGuCuagaagggB | 7991 |
| IKKg | 52 | CAGAGAAGUGAGGAC | 7871 | 24478 | guccuca*GGCTAGCTACAACGA*uuucucugB | 7992 |
| IKKg | 216 | GCAGCAGAUCAGGAC | 7876 | 24479 | guccuga*GGCTAGCTACAACGA*cugcugcB | 7993 |
| IKKg | 538 | UGAAGAGAUGCCAGC | 7877 | 24480 | gcugga*GGCTAGCTACAACGA*cucuucaB | 7994 |
| IKKg | 868 | UCCAAGAAUACGACA | 7878 | 24481 | ugucgua*GGCTAGCTACAACGA*ucuuggaB | 7995 |
| IKKg | 940 | AUCUCAAACAGCAGC | 7879 | 24482 | gcugcug*GGCTAGCTACAACGA*uugagauB | 7996 |
| IKKg | 52 | CAGAGAAGUGAGGAC | 7871 | 24483 | guccucaGgaggaaacucCCUUCaaggacaucgucCGGGuucucugB | 7997 |
| IKKg | 215 | GGCAGCAGAUCAGGA | 7880 | 24484 | uccugauGgaggaaacucCCUUCaaggacaucgucCGGGugcugccB | 7998 |
| IKKg | 817 | CGGAGGAAGAGGA | 7881 | 24485 | ucccucuGgaggaaacucCCUUCaaggacaucgucCGGGuccuccgB | 7999 |
| IKKg | 986 | ACAGGAGGUGAUCGA | 7882 | 24486 | ucgaucaGgaggaaacucCCUUCaaggacaucgucCGGGucccuguB | 8000 |
| IKKg | 1826 | CCUGGGAGUGCUGCC | 7883 | 24487 | ggcagcaGgaggaaacucCCUUCaaggacaucgucCGGGucccaggB | 8001 |

A, G, C, U = Ribo
A, G, C, T (*italic*) = deoxy
lower case = 2'-O-methyl
s = phosphorothioate 3'-internucleotide linkage
U = 2'-deoxy-2'-C-allyl uridine
<u>U</u> = 2'-deoxy-2'-Amino uridine
<u>C</u> = 2'-deoxy-2'-Amino cytidine TABLE XIII-continued Human IKK-gamma and PKR Nucleic Acid and Target molecules

| Gene | Pos | Target | Seq ID | RPI# | Enzymatic Nucleic Acid | Seq ID |
|------|-----|--------|--------|------|------------------------|--------|

I = Inosine
B = inverted deoxyabasic derivative

SEQUENCE LISTING (8014 sequences)

SEQ ID NO: 1 - RNA, 17 nt, Homo sapiens
ggcgcaguuugcucaua

SEQ ID NO: 2 - RNA, 17 nt, Homo sapiens
gcgcaguuugcucauac

SEQ ID NO: 3 - RNA, 17 nt, Homo sapiens
aguuugcucauacuuug

SEQ ID NO: 4 - RNA, 17 nt, Homo sapiens
uugcucauacuuuguga

SEQ ID NO: 5 - RNA, 17 nt, Homo sapiens
cucauacuuugugacuu

SEQ ID NO: 6 - RNA, 17 nt, Homo sapiens
ucauacuuugugacuug

SEQ ID NO: 7 - RNA, 17 nt, Homo sapiens
uugugacuugcggucac

SEQ ID NO: 8 - RNA, 17 nt, Homo sapiens
cuugcggucacaguggc

SEQ ID NO: 9 - RNA, 17 nt, Homo sapiens
aguggcauucagcucca

SEQ ID NO: 10 - RNA, 17 nt, Homo sapiens
guggcauucagcuccac

SEQ ID NO: 11 - RNA, 17 nt, Homo sapiens
auucagcuccacacuug

SEQ ID NO: 12 - RNA, 17 nt, Homo sapiens
uccacacuugguagaac

SEQ ID NO: 13 - RNA, 17 nt, Homo sapiens
cacuugguagaaccaca

SEQ ID NO: 14 - RNA, 17 nt, Homo sapiens
acaagcauagaaacauc

SEQ ID NO: 15 - RNA, 17 nt, Homo sapiens
agaaacauccuaaacaa

SEQ ID NO: 16 - RNA, 17 nt, Homo sapiens
aacauccuaaacaaucu

SEQ ID NO: 17 - RNA, 17 nt, Homo sapiens
uaaacaaucuucaucga

SEQ ID NO: 18 - RNA, 17 nt, Homo sapiens
aacaaucuucaucgagg

SEQ ID NO: 19 - RNA, 17 nt, Homo sapiens
acaaucuucaucgaggc

SEQ ID NO: 20 - RNA, 17 nt, Homo sapiens
aucuucaucgaggcauc

SEQ ID NO: 21 - RNA, 17 nt, Homo sapiens
cgaggcaucgaggucca

SEQ ID NO: 22 - RNA, 17 nt, Homo sapiens
aucgagguccaucccaa

SEQ ID NO: 23 - RNA, 17 nt, Homo sapiens
agguccaucccaauaaa

SEQ ID NO: 24 - RNA, 17 nt, Homo sapiens
aucccaauaaaaaucag

SEQ ID NO: 25 - RNA, 17 nt, Homo sapiens
auaaaaaucaggagacc

SEQ ID NO: 26 - RNA, 17 nt, Homo sapiens
cccuggcuaucauagac

SEQ ID NO: 27 - RNA, 17 nt, Homo sapiens
cuggcuaucauagaccu

SEQ ID NO: 28 - RNA, 17 nt, Homo sapiens
gcuaucauagaccuuag

SEQ ID NO: 29 - RNA, 17 nt, Homo sapiens
auagaccuuagucuucg

SEQ ID NO: 30 - RNA, 17 nt, Homo sapiens
uagaccuuagucuucgc

SEQ ID NO: 31 - RNA, 17 nt, Homo sapiens
accuuagucuucgcugg

SEQ ID NO: 32 - RNA, 17 nt, Homo sapiens
cuuagucuucgcuggua

SEQ ID NO: 33 - RNA, 17 nt, Homo sapiens
uuagucuucgcugguau

SEQ ID NO: 34 - RNA, 17 nt, Homo sapiens
ucgcugguauacucgcu

SEQ ID NO: 35 - RNA, 17 nt, Homo sapiens
gcugguauacucgcugu

SEQ ID NO: 36 - RNA, 17 nt, Homo sapiens
gguauacucgcugucug

SEQ ID NO: 37 - RNA, 17 nt, Homo sapiens
cucgcugucugucaacc

SEQ ID NO: 38 - RNA, 17 nt, Homo sapiens
cugucugucaaccagcg

SEQ ID NO: 39 - RNA, 17 nt, Homo sapiens
ccagcgguugacuuuuu

SEQ ID NO: 40 - RNA, 17 nt, Homo sapiens
gguugacuuuuuuuaag

SEQ ID NO: 41 - RNA, 17 nt, Homo sapiens
guugacuuuuuuuaagc

SEQ ID NO: 42 - RNA, 17 nt, Homo sapiens
uugacuuuuuuuaagcc

SEQ ID NO: 43 - RNA, 17 nt, Homo sapiens
ugacuuuuuuuaagccu

SEQ ID NO: 44 - RNA, 17 nt, Homo sapiens
gacuuuuuuuaagccuu

SEQ ID NO: 45 - RNA, 17 nt, Homo sapiens
acuuuuuuuaagccuuc

SEQ ID NO: 46 - RNA, 17 nt, Homo sapiens
cuuuuuuuaagccuucu

SEQ ID NO: 47 - RNA, 17 nt, Homo sapiens
uuaagccuucuuuuuuc

SEQ ID NO: 48 - RNA, 17 nt, Homo sapiens
uaagccuucuuuuuucu

SEQ ID NO: 49 - RNA, 17 nt, Homo sapiens
agccuucuuuuuucucu

SEQ ID NO: 50 - RNA, 17 nt, Homo sapiens
gccuucuuuuuucucuu

SEQ ID NO: 51 - RNA, 17 nt, Homo sapiens
ccuucuuuuuucucuuu

SEQ ID NO: 52 - RNA, 17 nt, Homo sapiens
cuucuuuuuucucuuuu

SEQ ID NO: 53 - RNA, 17 nt, Homo sapiens
uucuuuuuucucuuuua

SEQ ID NO: 54 - RNA, 17 nt, Homo sapiens
ucuuuuuucucuuuuac

SEQ ID NO: 55 - RNA, 17 nt, Homo sapiens
uuuuuucucuuuuacca

SEQ ID NO: 56 - RNA, 17 nt, Homo sapiens
uuuucucuuuuaccagu

SEQ ID NO: 57 - RNA, 17 nt, Homo sapiens
uuucucuuuuaccaguu

SEQ ID NO: 58 - RNA, 17 nt, Homo sapiens
uucucuuuuaccaguuu

SEQ ID NO: 59 - RNA, 17 nt, Homo sapiens
ucucuuuuaccaguuuc

SEQ ID NO: 60 - RNA, 17 nt, Homo sapiens
uuaccaguuucuggagc

SEQ ID NO: 61 - RNA, 17 nt, Homo sapiens
uaccaguuucuggagca

SEQ ID NO: 62 - RNA, 17 nt, Homo sapiens
accaguuucuggagcaa

SEQ ID NO: 63 - RNA, 17 nt, Homo sapiens
gagcaaauucaguuugc

SEQ ID NO: 64 - RNA, 17 nt, Homo sapiens
agcaaauucaguuugcc

SEQ ID NO: 65 - RNA, 17 nt, Homo sapiens
aauucaguuugccuucc

SEQ ID NO: 66 - RNA, 17 nt, Homo sapiens
auucaguuugccuuccu

SEQ ID NO: 67 - RNA, 17 nt, Homo sapiens
guuugccuuccuggauu

SEQ ID NO: 68 - RNA, 17 nt, Homo sapiens
uuugccuuccuggauuu

SEQ ID NO: 69 - RNA, 17 nt, Homo sapiens
uccuggauuuguaaauu

SEQ ID NO: 70 - RNA, 17 nt, Homo sapiens
ccuggauuuguaaauug

SEQ ID NO: 71 - RNA, 17 nt, Homo sapiens
ggauuuguaaauuguaa

SEQ ID NO: 72 - RNA, 17 nt, Homo sapiens
uuguaaauuguaaugac

SEQ ID NO: 73 - RNA, 17 nt, Homo sapiens
uaaauuguaaugaccuc

SEQ ID NO: 74 - RNA, 17 nt, Homo sapiens
aaugaccucaaaacuuu

SEQ ID NO: 75 - RNA, 17 nt, Homo sapiens
ucaaaacuuuagcaguu

SEQ ID NO: 76 - RNA, 17 nt, Homo sapiens
caaaacuuuagcaguuc

SEQ ID NO: 77 - RNA, 17 nt, Homo sapiens
aaaacuuuagcaguucu

SEQ ID NO: 78 - RNA, 17 nt, Homo sapiens
uuagcaguucuuccauc

SEQ ID NO: 79 - RNA, 17 nt, Homo sapiens
uagcaguucuuccaucu

SEQ ID NO: 80 - RNA, 17 nt, Homo sapiens
gcaguucuuccaucuga

SEQ ID NO: 81 - RNA, 17 nt, Homo sapiens
caguucuuccaucugac

SEQ ID NO: 82 - RNA, 17 nt, Homo sapiens
ucuuccaucugacucag

SEQ ID NO: 83 - RNA, 17 nt, Homo sapiens
aucugacucagguuugc

SEQ ID NO: 84 - RNA, 17 nt, Homo sapiens
acucagguuugcuucuc

SEQ ID NO: 85 - RNA, 17 nt, Homo sapiens
cucagguuugcuucucu

SEQ ID NO: 86 - RNA, 17 nt, Homo sapiens
gguuugcuucucuggcg

SEQ ID NO: 87 - RNA, 17 nt, Homo sapiens
guuugcuucucuggcgg

SEQ ID NO: 88 - RNA, 17 nt, Homo sapiens
uugcuucucuggcgguc

SEQ ID NO: 89 - RNA, 17 nt, Homo sapiens
cuggcggucuucagaau

SEQ ID NO: 90 - RNA, 17 nt, Homo sapiens
ggcggucuucagaauca

SEQ ID NO: 91 - RNA, 17 nt, Homo sapiens
gcggucuucagaaucaa

SEQ ID NO: 92 - RNA, 17 nt, Homo sapiens
uucagaaucaacaucca

SEQ ID NO: 93 - RNA, 17 nt, Homo sapiens
aucaacauccacacuuc

SEQ ID NO: 94 - RNA, 17 nt, Homo sapiens
uccacacuuccgugauu

SEQ ID NO: 95 - RNA, 17 nt, Homo sapiens
ccacacuuccgugauua

SEQ ID NO: 96 - RNA, 17 nt, Homo sapiens
uccgugauuaucugcgu

SEQ ID NO: 97 - RNA, 17 nt, Homo sapiens
ccgugauuaucugcgug

SEQ ID NO: 98 - RNA, 17 nt, Homo sapiens
gugauuaucugcgugca

SEQ ID NO: 99 - RNA, 17 nt, Homo sapiens
gcgugcauuuuggacaa

SEQ ID NO: 100 - RNA, 17 nt, Homo sapiens
cgugcauuuuggacaaa

SEQ ID NO: 101 - RNA, 17 nt, Homo sapiens
gugcauuuuggacaaag

SEQ ID NO: 102 - RNA, 17 nt, Homo sapiens
acaaagcuuccaaccag

SEQ ID NO: 103 - RNA, 17 nt, Homo sapiens
caaagcuuccaaccagg

SEQ ID NO: 104 - RNA, 17 nt, Homo sapiens
accaggauacgggaaga

SEQ ID NO: 105 - RNA, 17 nt, Homo sapiens
cuggugaucuuucagca

SEQ ID NO: 106 - RNA, 17 nt, Homo sapiens
ggugaucuuucagcagg

SEQ ID NO: 107 - RNA, 17 nt, Homo sapiens
gugaucuuucagcaggu

SEQ ID NO: 108 - RNA, 17 nt, Homo sapiens
ugaucuuucagcagguu

SEQ ID NO: 109 - RNA, 17 nt, Homo sapiens
cagcagguuucuucaug

SEQ ID NO: 110 - RNA, 17 nt, Homo sapiens
agcagguuucuucaugg

SEQ ID NO: 111 - RNA, 17 nt, Homo sapiens
gcagguuucuucaugga

SEQ ID NO: 112 - RNA, 17 nt, Homo sapiens
agguuucuucauggagg

SEQ ID NO: 113 - RNA, 17 nt, Homo sapiens
gguuucuucauggagga

SEQ ID NO: 114 - RNA, 17 nt, Homo sapiens
gaggaacuuaauacaua

SEQ ID NO: 115 - RNA, 17 nt, Homo sapiens
aggaacuuaauacauac

SEQ ID NO: 116 - RNA, 17 nt, Homo sapiens
aacuuaauacauaccgu

SEQ ID NO: 117 - RNA, 17 nt, Homo sapiens
uaauacauaccgucaga

SEQ ID NO: 118 - RNA, 17 nt, Homo sapiens
cauaccgucagaagcag

SEQ ID NO: 119 - RNA, 17 nt, Homo sapiens
cagggaguaguacuuaa

SEQ ID NO: 120 - RNA, 17 nt, Homo sapiens
ggaguaguacuuaaaua

SEQ ID NO: 121 - RNA, 17 nt, Homo sapiens
guaguacuuaaauauca

SEQ ID NO: 122 - RNA, 17 nt, Homo sapiens
uaguacuuaaauaucaa

SEQ ID NO: 123 - RNA, 17 nt, Homo sapiens
acuuaaauaucaagaac

SEQ ID NO: 124 - RNA, 17 nt, Homo sapiens
uuaaauaucaagaacug

SEQ ID NO: 125 - RNA, 17 nt, Homo sapiens
aacugccuaauucagga

SEQ ID NO: 126 - RNA, 17 nt, Homo sapiens
ugccuaauucaggaccu

SEQ ID NO: 127 - RNA, 17 nt, Homo sapiens
gccuaauucaggaccuc

SEQ ID NO: 128 - RNA, 17 nt, Homo sapiens
caggaccuccacaugau

SEQ ID NO: 129 - RNA, 17 nt, Homo sapiens
cacaugauaggagguuu

SEQ ID NO: 130 - RNA, 17 nt, Homo sapiens
uaggagguuuacauuuc

SEQ ID NO: 131 - RNA, 17 nt, Homo sapiens
aggagguuuacauuuca

SEQ ID NO: 132 - RNA, 17 nt, Homo sapiens
ggagguuuacauuucaa

SEQ ID NO: 133 - RNA, 17 nt, Homo sapiens
guuuacauuucaaguua

SEQ ID NO: 134 - RNA, 17 nt, Homo sapiens
uuuacauuucaaguuau

SEQ ID NO: 135 - RNA, 17 nt, Homo sapiens
uuacauuucaaguuaua

SEQ ID NO: 136 - RNA, 17 nt, Homo sapiens
uuucaaguuauaauaga

SEQ ID NO: 137 - RNA, 17 nt, Homo sapiens
uucaaguuauaauagau

SEQ ID NO: 138 - RNA, 17 nt, Homo sapiens
caaguuauaauagaugg

SEQ ID NO: 139 - RNA, 17 nt, Homo sapiens
guuauaauagauggaag

SEQ ID NO: 140 - RNA, 17 nt, Homo sapiens
aagagaauuuccagaag

SEQ ID NO: 141 - RNA, 17 nt, Homo sapiens
agagaauuuccagaagg

SEQ ID NO: 142 - RNA, 17 nt, Homo sapiens
gagaauuuccagaaggu

SEQ ID NO: 143 - RNA, 17 nt, Homo sapiens
gugaagguagaucaaag

SEQ ID NO: 144 - RNA, 17 nt, Homo sapiens
agguagaucaaagaagg

SEQ ID NO: 145 - RNA, 17 nt, Homo sapiens
agccaaauuagcuguug

SEQ ID NO: 146 - RNA, 17 nt, Homo sapiens
gccaaauuagcuguuga

SEQ ID NO: 147 - RNA, 17 nt, Homo sapiens
uuagcuguugagauacu

SEQ ID NO: 148 - RNA, 17 nt, Homo sapiens
guugagauacuuaauaa

SEQ ID NO: 149 - RNA, 17 nt, Homo sapiens
gagauacuuaauaagga

SEQ ID NO: 150 - RNA, 17 nt, Homo sapiens
agauacuuaauaaggaa

SEQ ID NO: 151 - RNA, 17 nt, Homo sapiens
uacuuaauaaggaaaag

SEQ ID NO: 152 - RNA, 17 nt, Homo sapiens
aaggcaguuaguccuuu

SEQ ID NO: 153 - RNA, 17 nt, Homo sapiens
aggcaguuaguccuuua

SEQ ID NO: 154 - RNA, 17 nt, Homo sapiens
caguuaguccuuuauua

SEQ ID NO: 155 - RNA, 17 nt, Homo sapiens
uuaguccuuuauuauug

SEQ ID NO: 156 - RNA, 17 nt, Homo sapiens
uaguccuuuauuauuga

SEQ ID NO: 157 - RNA, 17 nt, Homo sapiens
aguccuuuauuauugac

SEQ ID NO: 158 - RNA, 17 nt, Homo sapiens
uccuuuauuauugacaa

SEQ ID NO: 159 - RNA, 17 nt, Homo sapiens
ccuuuauuauugacaac

SEQ ID NO: 160 - RNA, 17 nt, Homo sapiens
uuuauuauugacaacaa

SEQ ID NO: 161 - RNA, 17 nt, Homo sapiens
caacgaauucuucagaa

SEQ ID NO: 162 - RNA, 17 nt, Homo sapiens
aacgaauucuucagaag

SEQ ID NO: 163 - RNA, 17 nt, Homo sapiens
cgaauucuucagaagga

SEQ ID NO: 164 - RNA, 17 nt, Homo sapiens
gaauucuucagaaggau

SEQ ID NO: 165 - RNA, 17 nt, Homo sapiens
agaaggauuauccaugg

SEQ ID NO: 166 - RNA, 17 nt, Homo sapiens
gaaggauuauccauggg

SEQ ID NO: 167 - RNA, 17 nt, Homo sapiens
aggauuauccaugggga

SEQ ID NO: 168 - RNA, 17 nt, Homo sapiens
uggggaauuacauaggc

SEQ ID NO: 169 - RNA, 17 nt, Homo sapiens
ggggaauuacauaggcc

SEQ ID NO: 170 - RNA, 17 nt, Homo sapiens
aauuacauaggccuuau

SEQ ID NO: 171 - RNA, 17 nt, Homo sapiens
auaggccuuaucaauag

SEQ ID NO: 172 - RNA, 17 nt, Homo sapiens
uaggccuuaucaauaga

SEQ ID NO: 173 - RNA, 17 nt, Homo sapiens
ggccuuaucaauagaau

SEQ ID NO: 174 - RNA, 17 nt, Homo sapiens<220>
uuaucaauagaauugcc

SEQ ID NO: 175 - RNA, 17 nt, Homo sapiens
aauagaauugcccagaa

SEQ ID NO: 176 - RNA, 17 nt, Homo sapiens
aaaagacuaacuguaaa

SEQ ID NO: 177 - RNA, 17 nt, Homo sapiens
cuaacuguaaauuauga

SEQ ID NO: 178 - RNA, 17 nt, Homo sapiens
cuguaaauuaugaacag

SEQ ID NO: 179 - RNA, 17 nt, Homo sapiens
uguaaauuaugaacagu

SEQ ID NO: 180 - RNA, 17 nt, Homo sapiens
gugugcaucgggggugc

SEQ ID NO: 181 - RNA, 17 nt, Homo sapiens
agaaggauuucauuaua

SEQ ID NO: 182 - RNA, 17 nt, Homo sapiens
gaaggauuucauuauaa

SEQ ID NO: 183 - RNA, 17 nt, Homo sapiens
aaggauuucauuauaaa

SEQ ID NO: 184 - RNA, 17 nt, Homo sapiens
gauuucauuauaaaugc

SEQ ID NO: 185 - RNA, 17 nt, Homo sapiens
auuucauuauaaaugca

SEQ ID NO: 186 - RNA, 17 nt, Homo sapiens
uucauuauaaaugcaaa

SEQ ID NO: 187 - RNA, 17 nt, Homo sapiens
gaaagaauauaguauug

SEQ ID NO: 188 - RNA, 17 nt, Homo sapiens
aagaauauaguauuggu

SEQ ID NO: 189 - RNA, 17 nt, Homo sapiens
aauauaguauugguaca

SEQ ID NO: 190 - RNA, 17 nt, Homo sapiens
uauaguauugguacagg

SEQ ID NO: 191 - RNA, 17 nt, Homo sapiens
guauugguacagguucu

SEQ ID NO: 192 - RNA, 17 nt, Homo sapiens
guacagguucuacuaaa

SEQ ID NO: 193 - RNA, 17 nt, Homo sapiens
uacagguucuacuaaac

SEQ ID NO: 194 - RNA, 17 nt, Homo sapiens
cagguucuacuaaacag

SEQ ID NO: 195 - RNA, 17 nt, Homo sapiens
guucuacuaaacaggaa

SEQ ID NO: 196 - RNA, 17 nt, Homo sapiens
aaaacaauuggccgcua

SEQ ID NO: 197 - RNA, 17 nt, Homo sapiens
uggccgcuaaacuugca

SEQ ID NO: 198 - RNA, 17 nt, Homo sapiens
gcuaaacuugcauaucu

SEQ ID NO: 199 - RNA, 17 nt, Homo sapiens
acuugcauaucuucaga

SEQ ID NO: 200 - RNA, 17 nt, Homo sapiens
uugcauaucuucagaua

SEQ ID NO: 201 - RNA, 17 nt, Homo sapiens
gcauaucuucagauauu

SEQ ID NO: 202 - RNA, 17 nt, Homo sapiens
cauaucuucagauauua

SEQ ID NO: 203 - RNA, 17 nt, Homo sapiens
cuucagauauuaucaga

SEQ ID NO: 204 - RNA, 17 nt, Homo sapiens
ucagauauuaucagaag

SEQ ID NO: 205 - RNA, 17 nt, Homo sapiens
cagauauuaucagaaga

SEQ ID NO: 206 - RNA, 17 nt, Homo sapiens
gauauuaucagaagaaa

SEQ ID NO: 207 - RNA, 17 nt, Homo sapiens
agaaaccucagugaaau

SEQ ID NO: 208 - RNA, 17 nt, Homo sapiens
agugaaaucugacuacc

SEQ ID NO: 209 - RNA, 17 nt, Homo sapiens
aucugacuaccuguccu

SEQ ID NO: 210 - RNA, 17 nt, Homo sapiens
cuaccuguccucugguu

SEQ ID NO: 211 - RNA, 17 nt, Homo sapiens
ccuguccucugguucuu

SEQ ID NO: 212 - RNA, 17 nt, Homo sapiens
ccucugguucuuuugcu

SEQ ID NO: 213 - RNA, 17 nt, Homo sapiens
cucugguucuuuugcua

SEQ ID NO: 214 - RNA, 17 nt, Homo sapiens
cugguucuuuugcuacu

SEQ ID NO: 215 - RNA, 17 nt, Homo sapiens
ugguucuuuugcuacua

SEQ ID NO: 216 - RNA, 17 nt, Homo sapiens
gguucuuuugcuacuac

SEQ ID NO: 217 - RNA, 17 nt, Homo sapiens
cuuuugcuacuacgugu

SEQ ID NO: 218 - RNA, 17 nt, Homo sapiens
uugcuacuacgugugag

SEQ ID NO: 219 - RNA, 17 nt, Homo sapiens
gugugagucccaaagca

SEQ ID NO: 220 - RNA, 17 nt, Homo sapiens
aagcaacucuuuaguga

SEQ ID NO: 221 - RNA, 17 nt, Homo sapiens
gcaacucuuuagugacc

SEQ ID NO: 222 - RNA, 17 nt, Homo sapiens
caacucuuuagugacca

SEQ ID NO: 223 - RNA, 17 nt, Homo sapiens
aacucuuuagugaccag

SEQ ID NO: 224 - RNA, 17 nt, Homo sapiens
agcacacucgcuucuga

SEQ ID NO: 225 - RNA, 17 nt, Homo sapiens
cacucgcuucugaauca

SEQ ID NO: 226 - RNA, 17 nt, Homo sapiens
acucgcuucugaaucau

SEQ ID NO: 227 - RNA, 17 nt, Homo sapiens
uucugaaucaucaucug

SEQ ID NO: 228 - RNA, 17 nt, Homo sapiens
ugaaucaucaucugaag

SEQ ID NO: 229 - RNA, 17 nt, Homo sapiens
aucaucaucugaaggug

SEQ ID NO: 230 - RNA, 17 nt, Homo sapiens
aggugacuucucagcag

SEQ ID NO: 231 - RNA, 17 nt, Homo sapiens
ggugacuucucagcaga

SEQ ID NO: 232 - RNA, 17 nt, Homo sapiens
ugacuucucagcagaua

SEQ ID NO: 233 - RNA, 17 nt, Homo sapiens
cagcagauacaucagag

SEQ ID NO: 234 - RNA, 17 nt, Homo sapiens
agauacaucagagauaa

SEQ ID NO: 235 - RNA, 17 nt, Homo sapiens
ucagagauaaauucuaa

SEQ ID NO: 236 - RNA, 17 nt, Homo sapiens
agauaaauucuaacagu

SEQ ID NO: 237 - RNA, 17 nt, Homo sapiens
gauaaauucuaacagug

SEQ ID NO: 238 - RNA, 17 nt, Homo sapiens
uaaauucuaacagugac

SEQ ID NO: 239 - RNA, 17 nt, Homo sapiens
gugacaguuuaaacagu

SEQ ID NO: 240 - RNA, 17 nt, Homo sapiens
ugacaguuuaaacaguu

SEQ ID NO: 241 - RNA, 17 nt, Homo sapiens
gacaguuuaaacaguuc

SEQ ID NO: 242 - RNA, 17 nt, Homo sapiens
uaaacaguucuucguug

SEQ ID NO: 243 - RNA, 17 nt, Homo sapiens
aaacaguucuucguugc

SEQ ID NO: 244 - RNA, 17 nt, Homo sapiens
acaguucuucguugcuu

SEQ ID NO: 245 - RNA, 17 nt, Homo sapiens
caguucuucguugcuua

SEQ ID NO: 246 - RNA, 17 nt, Homo sapiens
uucuucguugcuuauga

SEQ ID NO: 247 - RNA, 17 nt, Homo sapiens
ucguugcuuaugaaugg

SEQ ID NO: 248 - RNA, 17 nt, Homo sapiens
cguugcuuaugaauggu

SEQ ID NO: 249 - RNA, 17 nt, Homo sapiens
ugaauggucucagaaau

SEQ ID NO: 250 - RNA, 17 nt, Homo sapiens
aauggucucagaaauaa

SEQ ID NO: 251 - RNA, 17 nt, Homo sapiens
ucagaaauaaucaaagg

SEQ ID NO: 252 - RNA, 17 nt, Homo sapiens
gaaauaaucaaaggaag

SEQ ID NO: 253 - RNA, 17 nt, Homo sapiens
aaaaagaucuuuggcac

SEQ ID NO: 254 - RNA, 17 nt, Homo sapiens
aaagaucuuuggcaccc

SEQ ID NO: 255 - RNA, 17 nt, Homo sapiens
aagaucuuuggcaccca

SEQ ID NO: 256 - RNA, 17 nt, Homo sapiens
acccagauuugaccuuc

SEQ ID NO: 257 - RNA, 17 nt, Homo sapiens
cccagauuugaccuucc

SEQ ID NO: 258 - RNA, 17 nt, Homo sapiens
uuugaccuuccugacau

SEQ ID NO: 259 - RNA, 17 nt, Homo sapiens
uugaccuuccugacaug

SEQ ID NO: 260 - RNA, 17 nt, Homo sapiens
aacaaaguauacugugg

SEQ ID NO: 261 - RNA, 17 nt, Homo sapiens
caaaguauacuguggac

SEQ ID NO: 262 - RNA, 17 nt, Homo sapiens
caagagguuuggcaugg

SEQ ID NO: 263 - RNA, 17 nt, Homo sapiens
aagagguuuggcaugga

SEQ ID NO: 264 - RNA, 17 nt, Homo sapiens
gcauggauuuuaaagaa

SEQ ID NO: 265 - RNA, 17 nt, Homo sapiens
cauggauuuuaaagaaa

SEQ ID NO: 266 - RNA, 17 nt, Homo sapiens
auggauuuuaaagaaau

SEQ ID NO: 267 - RNA, 17 nt, Homo sapiens
uggauuuuaaagaaaua

SEQ ID NO: 268 - RNA, 17 nt, Homo sapiens
aaagaaauagaauuaau

SEQ ID NO: 269 - RNA, 17 nt, Homo sapiens
aauagaauuaauuggcu

SEQ ID NO: 270 - RNA, 17 nt, Homo sapiens
auagaauuaauuggcuc

SEQ ID NO: 271 - RNA, 17 nt, Homo sapiens
gaauuaauuggcucagg

SEQ ID NO: 272 - RNA, 17 nt, Homo sapiens
aauuggcucagguggau

SEQ ID NO: 273 - RNA, 17 nt, Homo sapiens
agguggauuuggccaag

SEQ ID NO: 274 - RNA, 17 nt, Homo sapiens
gguggauuuggccaagu

SEQ ID NO: 275 - RNA, 17 nt, Homo sapiens
ggccaaguuuucaaagc

SEQ ID NO: 276 - RNA, 17 nt, Homo sapiens
gccaaguuuucaaagca

SEQ ID NO: 277 - RNA, 17 nt, Homo sapiens
ccaaguuuucaaagcaa

SEQ ID NO: 278 - RNA, 17 nt, Homo sapiens
caaguuuucaaagcaaa

SEQ ID NO: 279 - RNA, 17 nt, Homo sapiens
cacagaauugacggaaa

SEQ ID NO: 280 - RNA, 17 nt, Homo sapiens
gaaagacuuacguuauu

SEQ ID NO: 281 - RNA, 17 nt, Homo sapiens
aaagacuuacguuauua

SEQ ID NO: 282 - RNA, 17 nt, Homo sapiens
acuuacguuauuaaacg

SEQ ID NO: 283 - RNA, 17 nt, Homo sapiens
cuuacguuauuaaacgu

SEQ ID NO: 284 - RNA, 17 nt, Homo sapiens
uacguuauuaaacgugu

SEQ ID NO: 285 - RNA, 17 nt, Homo sapiens
acguuauuaaacguguu

SEQ ID NO: 286 - RNA, 17 nt, Homo sapiens
aaacguguuaaauauaa

SEQ ID NO: 287 - RNA, 17 nt, Homo sapiens
aacguguuaaauauaau

SEQ ID NO: 288 - RNA, 17 nt, Homo sapiens
uguuaaauauaauaacg

SEQ ID NO: 289 - RNA, 17 nt, Homo sapiens
uuaaauauaauaacgag

SEQ ID NO: 290 - RNA, 17 nt, Homo sapiens
aauauaauaacgagaag

SEQ ID NO: 291 - RNA, 17 nt, Homo sapiens
cgugaaguaaaagcauu

SEQ ID NO: 292 - RNA, 17 nt, Homo sapiens
aaaagcauuggcaaaac

SEQ ID NO: 293 - RNA, 17 nt, Homo sapiens
gcaaaacuugaucaugu

SEQ ID NO: 294 - RNA, 17 nt, Homo sapiens
aacuugaucauguaaau

SEQ ID NO: 295 - RNA, 17 nt, Homo sapiens
gaucauguaaauauugu

SEQ ID NO: 296 - RNA, 17 nt, Homo sapiens
auguaaauauuguucac

SEQ ID NO: 297 - RNA, 17 nt, Homo sapiens
guaaauauuguucacua

SEQ ID NO: 298 - RNA, 17 nt, Homo sapiens
aauauuguucacuacaa

SEQ ID NO: 299 - RNA, 17 nt, Homo sapiens
auauuguucacuacaau

SEQ ID NO: 300 - RNA, 17 nt, Homo sapiens
uguucacuacaauggcu

SEQ ID NO: 301 - RNA, 17 nt, Homo sapiens
auggcuguugggaugga

SEQ ID NO: 302 - RNA, 17 nt, Homo sapiens
ggauggauuugauuaug

SEQ ID NO: 303 - RNA, 17 nt, Homo sapiens
gauggauuugauuauga

SEQ ID NO: 304 - RNA, 17 nt, Homo sapiens
gauuugauuaugauccu

SEQ ID NO: 305 - RNA, 17 nt, Homo sapiens
auuugauuaugauccug

SEQ ID NO: 306 - RNA, 17 nt, Homo sapiens
auuaugauccugagacc

SEQ ID NO: 307 - RNA, 17 nt, Homo sapiens
gugaugauucucuugag

SEQ ID NO: 308 - RNA, 17 nt, Homo sapiens
ugaugauucucuugaga

SEQ ID NO: 309 - RNA, 17 nt, Homo sapiens
augauucucuugagagc

SEQ ID NO: 310 - RNA, 17 nt, Homo sapiens
gauucucuugagagcag

SEQ ID NO: 311 - RNA, 17 nt, Homo sapiens
gcagugauuaugauccu

SEQ ID NO: 312 - RNA, 17 nt, Homo sapiens
cagugauuaugauccug

SEQ ID NO: 313 - RNA, 17 nt, Homo sapiens
auuaugauccugagaac

SEQ ID NO: 314 - RNA, 17 nt, Homo sapiens
gcaaaaauaguucaagg

SEQ ID NO: 315 - RNA, 17 nt, Homo sapiens
aaaauaguucaagguca

SEQ ID NO: 316 - RNA, 17 nt, Homo sapiens
aaauaguucaaggucaa

SEQ ID NO: 317 - RNA, 17 nt, Homo sapiens
uucaaggucaaagacua

SEQ ID NO: 318 - RNA, 17 nt, Homo sapiens
caaagacuaagugccuu

SEQ ID NO: 319 - RNA, 17 nt, Homo sapiens
aagugccuuuucaucca

SEQ ID NO: 320 - RNA, 17 nt, Homo sapiens
agugccuuuucauccaa

SEQ ID NO: 321 - RNA, 17 nt, Homo sapiens
gugccuuuucauccaaa

SEQ ID NO: 322 - RNA, 17 nt, Homo sapiens
ugccuuuucauccaaau

SEQ ID NO: 323 - RNA, 17 nt, Homo sapiens
cuuuucauccaaaugga

SEQ ID NO: 324 - RNA, 17 nt, Homo sapiens
aauggaauucugugaua

SEQ ID NO: 325 - RNA, 17 nt, Homo sapiens
auggaauucugugauaa

SEQ ID NO: 326 - RNA, 17 nt, Homo sapiens
ucugugauaaagggacc

SEQ ID NO: 327 - RNA, 17 nt, Homo sapiens
agggaccuuggaacaau

SEQ ID NO: 328 - RNA, 17 nt, Homo sapiens
caauggauugaaaaaag

SEQ ID NO: 329 - RNA, 17 nt, Homo sapiens
gagaaacuagacaaagu

SEQ ID NO: 330 - RNA, 17 nt, Homo sapiens
gacaaaguuuuggcuuu

SEQ ID NO: 331 - RNA, 17 nt, Homo sapiens
acaaaguuuuggcuuug

SEQ ID NO: 332 - RNA, 17 nt, Homo sapiens
caaaguuuuggcuuugg

SEQ ID NO: 333 - RNA, 17 nt, Homo sapiens
uuuuggcuuuggaacuc

SEQ ID NO: 334 - RNA, 17 nt, Homo sapiens
uuuggcuuuggaacucu

SEQ ID NO: 335 - RNA, 17 nt, Homo sapiens
uuggaacucuuugaaca

SEQ ID NO: 336 - RNA, 17 nt, Homo sapiens
ggaacucuuugaacaaa

SEQ ID NO: 337 - RNA, 17 nt, Homo sapiens
gaacucuuugaacaaau

SEQ ID NO: 338 - RNA, 17 nt, Homo sapiens
gaacaaauaacaaaagg

SEQ ID NO: 339 - RNA, 17 nt, Homo sapiens
ggguggauuauauacau

SEQ ID NO: 340 - RNA, 17 nt, Homo sapiens
gguggauuauauacauu

SEQ ID NO: 341 - RNA, 17 nt, Homo sapiens
uggauuauauacauuca

SEQ ID NO: 342 - RNA, 17 nt, Homo sapiens
gauuauauacauucaaa

SEQ ID NO: 343 - RNA, 17 nt, Homo sapiens
auauacauucaaaaaaa

SEQ ID NO: 344 - RNA, 17 nt, Homo sapiens
uauacauucaaaaaaau

SEQ ID NO: 345 - RNA, 17 nt, Homo sapiens
aaaaaaauuaauucaua

SEQ ID NO: 346 - RNA, 17 nt, Homo sapiens
aaaaaauuaauucauag

SEQ ID NO: 347 - RNA, 17 nt, Homo sapiens
aaauuaauucauagaga

SEQ ID NO: 348 - RNA, 17 nt, Homo sapiens
aauuaauucauagagau

SEQ ID NO: 349 - RNA, 17 nt, Homo sapiens
uaauucauagagaucuu

SEQ ID NO: 350 - RNA, 17 nt, Homo sapiens
auagagaucuuaagcca

SEQ ID NO: 351 - RNA, 17 nt, Homo sapiens
agagaucuuaagccaag

SEQ ID NO: 352 - RNA, 17 nt, Homo sapiens
gagaucuuaagccaagu

SEQ ID NO: 353 - RNA, 17 nt, Homo sapiens
agccaaguaauauauuc

SEQ ID NO: 354 - RNA, 17 nt, Homo sapiens
caaguaauauauucuua

SEQ ID NO: 355 - RNA, 17 nt, Homo sapiens
aguaauauauucuuagu

SEQ ID NO: 356 - RNA, 17 nt, Homo sapiens
uaauauauucuuaguag

SEQ ID NO: 357 - RNA, 17 nt, Homo sapiens
aauauauucuuaguaga

SEQ ID NO: 358 - RNA, 17 nt, Homo sapiens
uauauucuuaguagaua

SEQ ID NO: 359 - RNA, 17 nt, Homo sapiens
auauucuuaguagauac

SEQ ID NO: 360 - RNA, 17 nt, Homo sapiens
uucuuaguagauacaaa

SEQ ID NO: 361 - RNA, 17 nt, Homo sapiens
uaguagauacaaaacaa

SEQ ID NO: 362 - RNA, 17 nt, Homo sapiens
aaacaaguaaagauugg

SEQ ID NO: 363 - RNA, 17 nt, Homo sapiens
guaaagauuggagacuu

SEQ ID NO: 364 - RNA, 17 nt, Homo sapiens
uggagacuuuggacuug

SEQ ID NO: 365 - RNA, 17 nt, Homo sapiens
ggagacuuuggacuugu

SEQ ID NO: 366 - RNA, 17 nt, Homo sapiens
uuuggacuuguaacauc

SEQ ID NO: 367 - RNA, 17 nt, Homo sapiens
ggacuuguaacaucucu

SEQ ID NO: 368 - RNA, 17 nt, Homo sapiens
uguaacaucucugaaaa

SEQ ID NO: 369 - RNA, 17 nt, Homo sapiens
uaacaucucugaaaaau

SEQ ID NO: 370 - RNA, 17 nt, Homo sapiens
caaggaguaagggaacu

SEQ ID NO: 371 - RNA, 17 nt, Homo sapiens
agggaacuuugcgauac

SEQ ID NO: 372 - RNA, 17 nt, Homo sapiens
gggaacuuugcgauaca

SEQ ID NO: 373 - RNA, 17 nt, Homo sapiens
uuugcgauacaugagcc

SEQ ID NO: 374 - RNA, 17 nt, Homo sapiens
gaacagauuucuucgca

SEQ ID NO: 375 - RNA, 17 nt, Homo sapiens
aacagauuucuucgcaa

SEQ ID NO: 376 - RNA, 17 nt, Homo sapiens
acagauuucuucgcaag

SEQ ID NO: 377 - RNA, 17 nt, Homo sapiens
agauuucuucgcaagac

SEQ ID NO: 378 - RNA, 17 nt, Homo sapiens
gauuucuucgcaagacu

SEQ ID NO: 379 - RNA, 17 nt, Homo sapiens
gcaagacuauggaaagg

SEQ ID NO: 380 - RNA, 17 nt, Homo sapiens
guggaccucuacgcuuu

SEQ ID NO: 381 - RNA, 17 nt, Homo sapiens
ggaccucuacgcuuugg

SEQ ID NO: 382 - RNA, 17 nt, Homo sapiens
ucuacgcuuuggggcua

SEQ ID NO: 383 - RNA, 17 nt, Homo sapiens
cuacgcuuuggggcuaa

SEQ ID NO: 384 - RNA, 17 nt, Homo sapiens
uuggggcuaauucuugc

SEQ ID NO: 385 - RNA, 17 nt, Homo sapiens
gggcuaauucuugcuga

SEQ ID NO: 386 - RNA, 17 nt, Homo sapiens
ggcuaauucuugcugaa

SEQ ID NO: 387 - RNA, 17 nt, Homo sapiens
cuaauucuugcugaacu

SEQ ID NO: 388 - RNA, 17 nt, Homo sapiens
gcugaacuucuucaugu

SEQ ID NO: 389 - RNA, 17 nt, Homo sapiens
cugaacuucuucaugua

SEQ ID NO: 390 - RNA, 17 nt, Homo sapiens
gaacuucuucauguaug

SEQ ID NO: 391 - RNA, 17 nt, Homo sapiens
aacuucuucauguaugu

SEQ ID NO: 392 - RNA, 17 nt, Homo sapiens
cuucauguaugugacac

SEQ ID NO: 393 - RNA, 17 nt, Homo sapiens
acacugcuuuugaaaca

SEQ ID NO: 394 - RNA, 17 nt, Homo sapiens
cacugcuuuugaaacau

SEQ ID NO: 395 - RNA, 17 nt, Homo sapiens
acugcuuuugaaacauc

SEQ ID NO: 396 - RNA, 17 nt, Homo sapiens
ugaaacaucaaaguuuu

SEQ ID NO: 397 - RNA, 17 nt, Homo sapiens
aucaaaguuuuucacag

SEQ ID NO: 398 - RNA, 17 nt, Homo sapiens
ucaaaguuuuucacaga

SEQ ID NO: 399 - RNA, 17 nt, Homo sapiens
caaaguuuuucacagac

SEQ ID NO: 400 - RNA, 17 nt, Homo sapiens
aaaguuuuucacagacc

SEQ ID NO: 401 - RNA, 17 nt, Homo sapiens
aaguuuuucacagaccu

SEQ ID NO: 402 - RNA, 17 nt, Homo sapiens
acagaccuacgggaugg

SEQ ID NO: 403 - RNA, 17 nt, Homo sapiens
gauggcaucaucucaga

SEQ ID NO: 404 - RNA, 17 nt, Homo sapiens
ggcaucaucucagauau

SEQ ID NO: 405 - RNA, 17 nt, Homo sapiens
caucaucucagauauau

SEQ ID NO: 406 - RNA, 17 nt, Homo sapiens
ucucagauauauuugau

SEQ ID NO: 407 - RNA, 17 nt, Homo sapiens
ucagauauauuugauaa

SEQ ID NO: 408 - RNA, 17 nt, Homo sapiens
agauauauuugauaaaa

SEQ ID NO: 409 - RNA, 17 nt, Homo sapiens
gauauauuugauaaaaa

SEQ ID NO: 410 - RNA, 17 nt, Homo sapiens
uauuugauaaaaaagaa

SEQ ID NO: 411 - RNA, 17 nt, Homo sapiens
aaaaaacucuucuacag

SEQ ID NO: 412 - RNA, 17 nt, Homo sapiens
aaaacucuucuacagaa

SEQ ID NO: 413 - RNA, 17 nt, Homo sapiens
aaacucuucuacagaaa

SEQ ID NO: 414 - RNA, 17 nt, Homo sapiens
acucuucuacagaaauu

SEQ ID NO: 415 - RNA, 17 nt, Homo sapiens
acagaaauuacucucaa

SEQ ID NO: 416 - RNA, 17 nt, Homo sapiens
cagaaauuacucucaaa

SEQ ID NO: 417 - RNA, 17 nt, Homo sapiens
aaauuacucucaaagaa

SEQ ID NO: 418 - RNA, 17 nt, Homo sapiens
auuacucucaaagaaac

SEQ ID NO: 419 - RNA, 17 nt, Homo sapiens
cugaggaucgaccuaac

SEQ ID NO: 420 - RNA, 17 nt, Homo sapiens
aucgaccuaacacaucu

SEQ ID NO: 421 - RNA, 17 nt, Homo sapiens
uaacacaucugaaauac

SEQ ID NO: 422 - RNA, 17 nt, Homo sapiens
ucugaaauacuaaggac

SEQ ID NO: 423 - RNA, 17 nt, Homo sapiens
gaaauacuaaggaccuu

SEQ ID NO: 424 - RNA, 17 nt, Homo sapiens
aaggaccuugacugugu

SEQ ID NO: 425 - RNA, 17 nt, Homo sapiens
acacauguuagagcccu

SEQ ID NO: 426 - RNA, 17 nt, Homo sapiens
cacauguuagagcccuu

SEQ ID NO: 427 - RNA, 17 nt, Homo sapiens
agagcccuucugaaaaa

SEQ ID NO: 428 - RNA, 17 nt, Homo sapiens
gagcccuucugaaaaag

SEQ ID NO: 429 - RNA, 17 nt, Homo sapiens
gaaaaaguauccugcuu

SEQ ID NO: 430 - RNA, 17 nt, Homo sapiens<220>
aaaaguauccugcuucu

SEQ ID NO: 431 - RNA, 17 nt, Homo sapiens
auccugcuucugauaug

SEQ ID NO: 432 - RNA, 17 nt, Homo sapiens
uccugcuucugauaugc

SEQ ID NO: 433 - RNA, 17 nt, Homo sapiens
cuucugauaugcaguuu

SEQ ID NO: 434 - RNA, 17 nt, Homo sapiens
uaugcaguuuuccuuaa

SEQ ID NO: 435 - RNA, 17 nt, Homo sapiens
augcaguuuuccuuaaa

SEQ ID NO: 436 - RNA, 17 nt, Homo sapiens
ugcaguuuuccuuaaau

SEQ ID NO: 437 - RNA, 17 nt, Homo sapiens
gcaguuuuccuuaaauu

SEQ ID NO: 438 - RNA, 17 nt, Homo sapiens
guuuuccuuaaauuauc

SEQ ID NO: 439 - RNA, 17 nt, Homo sapiens
uuuuccuuaaauuaucu

SEQ ID NO: 440 - RNA, 17 nt, Homo sapiens
ccuuaaauuaucuaaaa

SEQ ID NO: 441 - RNA, 17 nt, Homo sapiens
cuuaaauuaucuaaaau

SEQ ID NO: 442 - RNA, 17 nt, Homo sapiens
uaaauuaucuaaaaucu

SEQ ID NO: 443 - RNA, 17 nt, Homo sapiens
aauuaucuaaaaucugc

SEQ ID NO: 444 - RNA, 17 nt, Homo sapiens
ucuaaaaucugcuaggg

SEQ ID NO: 445 - RNA, 17 nt, Homo sapiens
aaucugcuagggaauau

SEQ ID NO: 446 - RNA, 17 nt, Homo sapiens
uagggaauaucaauaga

SEQ ID NO: 447 - RNA, 17 nt, Homo sapiens
gggaauaucaauagaua

SEQ ID NO: 448 - RNA, 17 nt, Homo sapiens
auaucaauagauauuua

SEQ ID NO: 449 - RNA, 17 nt, Homo sapiens
caauagauauuuaccuu

SEQ ID NO: 450 - RNA, 17 nt, Homo sapiens
auagauauuuaccuuuu

SEQ ID NO: 451 - RNA, 17 nt, Homo sapiens
uagauauuuaccuuuua

SEQ ID NO: 452 - RNA, 17 nt, Homo sapiens
agauauuuaccuuuuau

SEQ ID NO: 453 - RNA, 17 nt, Homo sapiens
auuuaccuuuuauuuua

SEQ ID NO: 454 - RNA, 17 nt, Homo sapiens
uuuaccuuuuauuuuaa

SEQ ID NO: 455 - RNA, 17 nt, Homo sapiens
uuaccuuuuauuuuaau

SEQ ID NO: 456 - RNA, 17 nt, Homo sapiens
uaccuuuuauuuuaaug

SEQ ID NO: 457 - RNA, 17 nt, Homo sapiens
ccuuuuauuuuaauguu

SEQ ID NO: 458 - RNA, 17 nt, Homo sapiens
cuuuuauuuuaauguuu

SEQ ID NO: 459 - RNA, 17 nt, Homo sapiens
uuuuauuuuaauguuuc

SEQ ID NO: 460 - RNA, 17 nt, Homo sapiens
uuuauuuuaauguuucc

SEQ ID NO: 461 - RNA, 17 nt, Homo sapiens
uuuaauguuuccuuuaa

SEQ ID NO: 462 - RNA, 17 nt, Homo sapiens
uuaauguuuccuuuaau

SEQ ID NO: 463 - RNA, 17 nt, Homo sapiens
uaauguuuccuuuaauu

SEQ ID NO: 464 - RNA, 17 nt, Homo sapiens
uguuuccuuuaauuuuu

SEQ ID NO: 465 - RNA, 17 nt, Homo sapiens
guuuccuuuaauuuuuu

SEQ ID NO: 466 - RNA, 17 nt, Homo sapiens
uuuccuuuaauuuuuua

SEQ ID NO: 467 - RNA, 17 nt, Homo sapiens
ccuuuaauuuuuuacua

SEQ ID NO: 468 - RNA, 17 nt, Homo sapiens
cuuuaauuuuuuacuau

SEQ ID NO: 469 - RNA, 17 nt, Homo sapiens
uuuaauuuuuuacuauu

SEQ ID NO: 470 - RNA, 17 nt, Homo sapiens
uuaauuuuuuacuauuu

SEQ ID NO: 471 - RNA, 17 nt, Homo sapiens
uaauuuuuuacuauuuu

SEQ ID NO: 472 - RNA, 17 nt, Homo sapiens
aauuuuuuacuauuuuu

SEQ ID NO: 473 - RNA, 17 nt, Homo sapiens
uuuuuacuauuuuuacu

SEQ ID NO: 474 - RNA, 17 nt, Homo sapiens
uuuacuauuuuuacuaa

SEQ ID NO: 475 - RNA, 17 nt, Homo sapiens
uuacuauuuuuacuaau

SEQ ID NO: 476 - RNA, 17 nt, Homo sapiens
uacuauuuuuacuaauc

SEQ ID NO: 477 - RNA, 17 nt, Homo sapiens
acuauuuuuacuaaucu

SEQ ID NO: 478 - RNA, 17 nt, Homo sapiens
cuauuuuuacuaaucuu

SEQ ID NO: 479 - RNA, 17 nt, Homo sapiens
uuuuuacuaaucuuucu

SEQ ID NO: 480 - RNA, 17 nt, Homo sapiens
uuacuaaucuuucugca

SEQ ID NO: 481 - RNA, 17 nt, Homo sapiens
acuaaucuuucugcaga

SEQ ID NO: 482 - RNA, 17 nt, Homo sapiens
cuaaucuuucugcagaa

SEQ ID NO: 483 - RNA, 17 nt, Homo sapiens
uaaucuuucugcagaaa

SEQ ID NO: 484 - RNA, 17 nt, Homo sapiens
agaaagguuuucuucuu

SEQ ID NO: 485 - RNA, 17 nt, Homo sapiens
gaaagguuuucuucuuu

SEQ ID NO: 486 - RNA, 17 nt, Homo sapiens
aaagguuuucuucuuuu

SEQ ID NO: 487 - RNA, 17 nt, Homo sapiens
aagguuuucuucuuuuu

SEQ ID NO: 488 - RNA, 17 nt, Homo sapiens
gguuuucuucuuuuugc

SEQ ID NO: 489 - RNA, 17 nt, Homo sapiens
guuuucuucuuuuugcu

SEQ ID NO: 490 - RNA, 17 nt, Homo sapiens
uuucuucuuuuugcuuc

SEQ ID NO: 491 - RNA, 17 nt, Homo sapiens
uucuucuuuuugcuuca

SEQ ID NO: 492 - RNA, 17 nt, Homo sapiens
ucuucuuuuugcuucaa

SEQ ID NO: 493 - RNA, 17 nt, Homo sapiens
cuucuuuuugcuucaaa

SEQ ID NO: 494 - RNA, 17 nt, Homo sapiens
uuuuugcuucaaaaaca

SEQ ID NO: 495 - RNA, 17 nt, Homo sapiens
uuuugcuucaaaaacau

SEQ ID NO: 496 - RNA, 17 nt, Homo sapiens
aaaaacauucuuacauu

SEQ ID NO: 497 - RNA, 17 nt, Homo sapiens
aaaacauucuuacauuu

SEQ ID NO: 498 - RNA, 17 nt, Homo sapiens
aacauucuuacauuuua

SEQ ID NO: 499 - RNA, 17 nt, Homo sapiens
acauucuuacauuuuac

SEQ ID NO: 500 - RNA, 17 nt, Homo sapiens
ucuuacauuuuacuuuu

SEQ ID NO: 501 - RNA, 17 nt, Homo sapiens
cuuacauuuuacuuuuu

SEQ ID NO: 502 - RNA, 17 nt, Homo sapiens
uuacauuuuacuuuuuc

SEQ ID NO: 503 - RNA, 17 nt, Homo sapiens
uacauuuuacuuuuucc

SEQ ID NO: 504 - RNA, 17 nt, Homo sapiens
auuuuacuuuuuccugg

SEQ ID NO: 505 - RNA, 17 nt, Homo sapiens
uuuuacuuuuuccuggc

SEQ ID NO: 506 - RNA, 17 nt, Homo sapiens
uuuacuuuuuccuggcu

SEQ ID NO: 507 - RNA, 17 nt, Homo sapiens
uuacuuuuuccuggcuc

SEQ ID NO: 508 - RNA, 17 nt, Homo sapiens
uacuuuuuccuggcuca

SEQ ID NO: 509 - RNA, 17 nt, Homo sapiens
uccuggcucaucucuuu

SEQ ID NO: 510 - RNA, 17 nt, Homo sapiens
uggcucaucucuuuauu

SEQ ID NO: 511 - RNA, 17 nt, Homo sapiens
gcucaucucuuuauucu

SEQ ID NO: 512 - RNA, 17 nt, Homo sapiens
ucaucucuuuauucuuu

SEQ ID NO: 513 - RNA, 17 nt, Homo sapiens
caucucuuuauucuuuu

SEQ ID NO: 514 - RNA, 17 nt, Homo sapiens
aucucuuuauucuuuuu

SEQ ID NO: 515 - RNA, 17 nt, Homo sapiens
cucuuuauucuuuuuuu

SEQ ID NO: 516 - RNA, 17 nt, Homo sapiens
ucuuuauucuuuuuuuu

SEQ ID NO: 517 - RNA, 17 nt, Homo sapiens
uuuauucuuuuuuuuuu

SEQ ID NO: 518 - RNA, 17 nt, Homo sapiens
uuauucuuuuuuuuuuu

SEQ ID NO: 519 - RNA, 17 nt, Homo sapiens
uauucuuuuuuuuuuuu

SEQ ID NO: 520 - RNA, 17 nt, Homo sapiens
auucuuuuuuuuuuuuu

SEQ ID NO: 521 - RNA, 17 nt, Homo sapiens
uucuuuuuuuuuuuuuu

SEQ ID NO: 522 - RNA, 17 nt, Homo sapiens
ucuuuuuuuuuuuuuua

SEQ ID NO: 523 - RNA, 17 nt, Homo sapiens
cuuuuuuuuuuuuuuaa

SEQ ID NO: 524 - RNA, 17 nt, Homo sapiens
uuuuuuuuuuuuuuaaa

SEQ ID NO: 525 - RNA, 17 nt, Homo sapiens
uuuuuuuuuuuuuaaag

SEQ ID NO: 526 - RNA, 17 nt, Homo sapiens
uuuuuuuuuuuuaaaga

SEQ ID NO: 527 - RNA, 17 nt, Homo sapiens
uuuuuuuuuuuaaagac

SEQ ID NO: 528 - RNA, 17 nt, Homo sapiens
uuuuuuuuuuaaagaca

SEQ ID NO: 529 - RNA, 17 nt, Homo sapiens
uuuuuuuuuaaagacag

SEQ ID NO: 530 - RNA, 17 nt, Homo sapiens
uuuuuuuuaaagacaga

SEQ ID NO: 531 - RNA, 17 nt, Homo sapiens
gacagagucucgcucug

SEQ ID NO: 532 - RNA, 17 nt, Homo sapiens
cagagucucgcucuguu

SEQ ID NO: 533 - RNA, 17 nt, Homo sapiens
gucucgcucuguugccc

SEQ ID NO: 534 - RNA, 17 nt, Homo sapiens
cgcucuguugcccaggc

SEQ ID NO: 535 - RNA, 17 nt, Homo sapiens
gacacagucuuggcuca

SEQ ID NO: 536 - RNA, 17 nt, Homo sapiens
cacagucuuggcucacu

SEQ ID NO: 537 - RNA, 17 nt, Homo sapiens
ucuuggcucacugcaac

SEQ ID NO: 538 - RNA, 17 nt, Homo sapiens
cugcaacuucugccucu

SEQ ID NO: 539 - RNA, 17 nt, Homo sapiens
ugcaacuucugccucuu

SEQ ID NO: 540 - RNA, 17 nt, Homo sapiens
uucugccucuuggguuc

SEQ ID NO: 541 - RNA, 17 nt, Homo sapiens
cugccucuuggguucaa

SEQ ID NO: 542 - RNA, 17 nt, Homo sapiens
ucuuggguucaagugau

SEQ ID NO: 543 - RNA, 17 nt, Homo sapiens
cuuggguucaagugauu

SEQ ID NO: 544 - RNA, 17 nt, Homo sapiens
caagugauucuccugcc

SEQ ID NO: 545 - RNA, 17 nt, Homo sapiens
aagugauucuccugccu

SEQ ID NO: 546 - RNA, 17 nt, Homo sapiens
gugauucuccugccuca

SEQ ID NO: 547 - RNA, 17 nt, Homo sapiens
uccugccucagccuccu

SEQ ID NO: 548 - RNA, 17 nt, Homo sapiens
cucagccuccugaguag

SEQ ID NO: 549 - RNA, 17 nt, Homo sapiens
uccugaguagcuggauu

SEQ ID NO: 550 - RNA, 17 nt, Homo sapiens
agcuggauuacaggcau

SEQ ID NO: 551 - RNA, 17 nt, Homo sapiens
gcuggauuacaggcaug

SEQ ID NO: 552 - RNA, 17 nt, Homo sapiens
acccaacuaauuuuugu

SEQ ID NO: 553 - RNA, 17 nt, Homo sapiens
caacuaauuuuuguguu

SEQ ID NO: 554 - RNA, 17 nt, Homo sapiens
aacuaauuuuuguguuu

SEQ ID NO: 555 - RNA, 17 nt, Homo sapiens
acuaauuuuuguguuuu

SEQ ID NO: 556 - RNA, 17 nt, Homo sapiens
cuaauuuuuguguuuuu

SEQ ID NO: 557 - RNA, 17 nt, Homo sapiens
uuuuguguuuuuaauaa

SEQ ID NO: 558 - RNA, 17 nt, Homo sapiens
uuuguguuuuuaauaaa

SEQ ID NO: 559 - RNA, 17 nt, Homo sapiens
uuguguuuuuaauaaag

SEQ ID NO: 560 - RNA, 17 nt, Homo sapiens
uguguuuuuaauaaaga

SEQ ID NO: 561 - RNA, 17 nt, Homo sapiens
guguuuuuaauaaagac

SEQ ID NO: 562 - RNA, 17 nt, Homo sapiens
uuuuuaauaaagacagg

SEQ ID NO: 563 - RNA, 17 nt, Homo sapiens
gacaggguuucaccaug

SEQ ID NO: 564 - RNA, 17 nt, Homo sapiens
acaggguuucaccaugu

SEQ ID NO: 565 - RNA, 17 nt, Homo sapiens
caggguuucaccauguu

SEQ ID NO: 566 - RNA, 17 nt, Homo sapiens
caccauguuggccaggc

SEQ ID NO: 567 - RNA, 17 nt, Homo sapiens
aggcuggucucaaacuc

SEQ ID NO: 568 - RNA, 17 nt, Homo sapiens
gcuggucucaaacuccu

SEQ ID NO: 569 - RNA, 17 nt, Homo sapiens
cucaaacuccugaccuc

SEQ ID NO: 570 - RNA, 17 nt, Homo sapiens
ccugaccucaaguaauc

SEQ ID NO: 571 - RNA, 17 nt, Homo sapiens
ccucaaguaauccaccu

SEQ ID NO: 572 - RNA, 17 nt, Homo sapiens
caaguaauccaccugcc

SEQ ID NO: 573 - RNA, 17 nt, Homo sapiens
accugccucggccuccc

SEQ ID NO: 574 - RNA, 17 nt, Homo sapiens
cucggccucccaaagug

SEQ ID NO: 575 - RNA, 17 nt, Homo sapiens
gcugggauuacagggau

SEQ ID NO: 576 - RNA, 17 nt, Homo sapiens
cugggauuacagggaug

SEQ ID NO: 577 - RNA, 17 nt, Homo sapiens
cccagccucaucucuuu

SEQ ID NO: 578 - RNA, 17 nt, Homo sapiens
agccucaucucuuuguu

SEQ ID NO: 579 - RNA, 17 nt, Homo sapiens
ccucaucucuuuguucu

SEQ ID NO: 580 - RNA, 17 nt, Homo sapiens
ucaucucuuuguucuaa

SEQ ID NO: 581 - RNA, 17 nt, Homo sapiens
caucucuuuguucuaaa

SEQ ID NO: 582 - RNA, 17 nt, Homo sapiens
cucuuuguucuaaagau

SEQ ID NO: 583 - RNA, 17 nt, Homo sapiens
ucuuuguucuaaagaug

SEQ ID NO: 584 - RNA, 17 nt, Homo sapiens
uuuguucuaaagaugga

SEQ ID NO: 585 - RNA, 17 nt, Homo sapiens
ccccaaauuuucuuuuu

SEQ ID NO: 586 - RNA, 17 nt, Homo sapiens
cccaaauuuucuuuuua

SEQ ID NO: 587 - RNA, 17 nt, Homo sapiens
ccaaauuuucuuuuuau

SEQ ID NO: 588 - RNA, 17 nt, Homo sapiens
caaauuuucuuuuuaua

SEQ ID NO: 589 - RNA, 17 nt, Homo sapiens
aauuuucuuuuuauacu

SEQ ID NO: 590 - RNA, 17 nt, Homo sapiens
auuuucuuuuuauacua

SEQ ID NO: 591 - RNA, 17 nt, Homo sapiens
uuuucuuuuuauacuau

SEQ ID NO: 592 - RNA, 17 nt, Homo sapiens
uuucuuuuuauacuauu

SEQ ID NO: 593 - RNA, 17 nt, Homo sapiens
uucuuuuuauacuauua

SEQ ID NO: 594 - RNA, 17 nt, Homo sapiens
cuuuuuauacuauuaau

SEQ ID NO: 595 - RNA, 17 nt, Homo sapiens
uuuauacuauuaaugaa

SEQ ID NO: 596 - RNA, 17 nt, Homo sapiens
uauacuauuaaugaauc

SEQ ID NO: 597 - RNA, 17 nt, Homo sapiens
auacuauuaaugaauca

SEQ ID NO: 598 - RNA, 17 nt, Homo sapiens
uaaugaaucaaucaauu

SEQ ID NO: 599 - RNA, 17 nt, Homo sapiens
gaaucaaucaauucaua

SEQ ID NO: 600 - RNA, 17 nt, Homo sapiens
caaucaauucauaucua

SEQ ID NO: 601 - RNA, 17 nt, Homo sapiens
aaucaauucauaucuau

SEQ ID NO: 602 - RNA, 17 nt, Homo sapiens
caauucauaucuauuua

SEQ ID NO: 603 - RNA, 17 nt, Homo sapiens
auucauaucuauuuauu

SEQ ID NO: 604 - RNA, 17 nt, Homo sapiens
ucauaucuauuuauuaa

SEQ ID NO: 605 - RNA, 17 nt, Homo sapiens
auaucuauuuauuaaau

SEQ ID NO: 606 - RNA, 17 nt, Homo sapiens
uaucuauuuauuaaauu

SEQ ID NO: 607 - RNA, 17 nt, Homo sapiens
aucuauuuauuaaauuu

SEQ ID NO: 608 - RNA, 17 nt, Homo sapiens
cuauuuauuaaauuucu

SEQ ID NO: 609 - RNA, 17 nt, Homo sapiens
uauuuauuaaauuucua

SEQ ID NO: 610 - RNA, 17 nt, Homo sapiens
uauuaaauuucuaccgc

SEQ ID NO: 611 - RNA, 17 nt, Homo sapiens
auuaaauuucuaccgcu

SEQ ID NO: 612 - RNA, 17 nt, Homo sapiens
uuaaauuucuaccgcuu

SEQ ID NO: 613 - RNA, 17 nt, Homo sapiens
aaauuucuaccgcuuuu

SEQ ID NO: 614 - RNA, 17 nt, Homo sapiens
cuaccgcuuuuaggcca

SEQ ID NO: 615 - RNA, 17 nt, Homo sapiens
uaccgcuuuuaggccaa

SEQ ID NO: 616 - RNA, 17 nt, Homo sapiens
accgcuuuuaggccaaa

SEQ ID NO: 617 - RNA, 17 nt, Homo sapiens
ccgcuuuuaggccaaaa

SEQ ID NO: 618 - RNA, 17 nt, Homo sapiens
aaaaauguaagaucguu

SEQ ID NO: 619 - RNA, 17 nt, Homo sapiens
uguaagaucguucucug

SEQ ID NO: 620 - RNA, 17 nt, Homo sapiens
aagaucguucucugccu

SEQ ID NO: 621 - RNA, 17 nt, Homo sapiens
agaucguucucugccuc

SEQ ID NO: 622 - RNA, 17 nt, Homo sapiens
aucguucucugccucac

SEQ ID NO: 623 - RNA, 17 nt, Homo sapiens
cucugccucacauagcu

SEQ ID NO: 624 - RNA, 17 nt, Homo sapiens
ccucacauagcuuacaa

SEQ ID NO: 625 - RNA, 17 nt, Homo sapiens
acauagcuuacaagcca

SEQ ID NO: 626 - RNA, 17 nt, Homo sapiens
cauagcuuacaagccag

SEQ ID NO: 627 - RNA, 17 nt, Homo sapiens
ggagaaauaugguacuc

SEQ ID NO: 628 - RNA, 17 nt, Homo sapiens
aauaugguacucauuaa

SEQ ID NO: 629 - RNA, 17 nt, Homo sapiens
augguacucauuaaaaa

SEQ ID NO: 630 - RNA, 17 nt, Homo sapiens
guacucauuaaaaaaaa

SEQ ID NO: 631 - RNA, 17 nt, Homo sapiens
uacucauuaaaaaaaaa

SEQ ID NO: 632 - RNA, 38 nt, Artificial Sequence
  Description of Artificial Sequence:  Enzymatic Nucleic Acid
uaugagcacugaugaggccguuaggccgaaacugcgcc

SEQ ID NO: 633 - RNA, 38 nt, Artificial Sequence
  Description of Artificial Sequence:  Enzymatic Nucleic Acid
guaugagccugaugaggccguuaggccgaaaacugcgc

SEQ ID NO: 634 - RNA, 38 nt, Artificial Sequence
  Description of Artificial Sequence:  Enzymatic Nucleic Acid
caaaguaucugaugaggccguuaggccgaaagcaaacu

SEQ ID NO: 635 - RNA, 38 nt, Artificial Sequence
  Description of Artificial Sequence:  Enzymatic Nucleic Acid
ucacaaagcugaugaggccguuaggccgaaaugagcaa

SEQ ID NO: 636 - RNA, 38 nt, Artificial Sequence
  Description of Artificial Sequence:  Enzymatic Nucleic Acid
aagucacacugaugaggccguuaggccgaaaguaugag

SEQ ID NO: 637 - RNA, 38 nt, Artificial Sequence
  Description of Artificial Sequence:  Enzymatic Nucleic Acid
caagucaccugaugaggccguuaggccgaaaaguauga

SEQ ID NO: 638 - RNA, 38 nt, Artificial Sequence
  Description of Artificial Sequence:  Enzymatic Nucleic Acid
gugaccgccugaugaggccguuaggccgaaagucacaa

SEQ ID NO: 639 - RNA, 38 nt, Artificial Sequence
  Description of Artificial Sequence:  Enzymatic Nucleic Acid
gccacugucugaugaggccguuaggccgaaaccgcaag

SEQ ID NO: 640 - RNA, 38 nt, Artificial Sequence
  Description of Artificial Sequence:  Enzymatic Nucleic Acid
uggagcugcugaugaggccguuaggccgaaaugccacu

SEQ ID NO: 641 - RNA, 38 nt, Artificial Sequence
  Description of Artificial Sequence:  Enzymatic Nucleic Acid
guggagcucugaugaggccguuaggccgaaaaugccac

SEQ ID NO: 642 - RNA, 38 nt, Artificial Sequence
  Description of Artificial Sequence:  Enzymatic Nucleic Acid
caagugugcugaugaggccguuaggccgaaagcugaau

SEQ ID NO: 643 - RNA, 38 nt, Artificial Sequence
  Description of Artificial Sequence:  Enzymatic Nucleic Acid
guucuacccugaugaggccguuaggccgaaagugugga

SEQ ID NO: 644 - RNA, 38 nt, Artificial Sequence
  Description of Artificial Sequence:  Enzymatic Nucleic Acid
ugugguuccugaugaggccguuaggccgaaaccaagug

SEQ ID NO: 645 - RNA, 38 nt, Artificial Sequence
  Description of Artificial Sequence:  Enzymatic Nucleic Acid
gauguuuccugaugaggccguuaggccgaaaugcuugu

SEQ ID NO: 646 - RNA, 38 nt, Artificial Sequence
  Description of Artificial Sequence:  Enzymatic Nucleic Acid
uuguuuagcugaugaggccguuaggccgaaauguuucu

SEQ ID NO: 647 - RNA, 38 nt, Artificial Sequence
  Description of Artificial Sequence:  Enzymatic Nucleic Acid
agauuguucugaugaggccguuaggccgaaaggauguu

SEQ ID NO: 648 - RNA, 38 nt, Artificial Sequence
  Description of Artificial Sequence:  Enzymatic Nucleic Acid
ucgaugaacugaugaggccguuaggccgaaauuguuua

SEQ ID NO: 649 - RNA, 38 nt, Artificial Sequence
  Description of Artificial Sequence:  Enzymatic Nucleic Acid
ccucgaugcugaugaggccguuaggccgaaagauuguu

SEQ ID NO: 650 - RNA, 38 nt, Artificial Sequence
  Description of Artificial Sequence:  Enzymatic Nucleic Acid
gccucgaucugaugaggccguuaggccgaaaagauugu

SEQ ID NO: 651 - RNA, 38 nt, Artificial Sequence
  Description of Artificial Sequence:  Enzymatic Nucleic Acid
gaugccuccugaugaggccguuaggccgaaaugaagau

SEQ ID NO: 652 - RNA, 38 nt, Artificial Sequence
  Description of Artificial Sequence:  Enzymatic Nucleic Acid
uggaccuccugaugaggccguuaggccgaaaugccucg

SEQ ID NO: 653 - RNA, 38 nt, Artificial Sequence
  Description of Artificial Sequence:  Enzymatic Nucleic Acid
uugggaugcugaugaggccguuaggccgaaaccucgau

SEQ ID NO: 654 - RNA, 38 nt, Artificial Sequence
  Description of Artificial Sequence:  Enzymatic Nucleic Acid
uuuauuggcugaugaggccguuaggccgaaauggaccu

SEQ ID NO: 655 - RNA, 38 nt, Artificial Sequence
  Description of Artificial Sequence:  Enzymatic Nucleic Acid
cugauuuucugaugaggccguuaggccgaaauugggau

SEQ ID NO: 656 - RNA, 38 nt, Artificial Sequence
  Description of Artificial Sequence:  Enzymatic Nucleic Acid
ggucuccucugaugaggccguuaggccgaaauuuuuau

SEQ ID NO: 657 - RNA, 38 nt, Artificial Sequence
  Description of Artificial Sequence:  Enzymatic Nucleic Acid
gucuaugacugaugaggccguuaggccgaaagccaggg

SEQ ID NO: 658 - RNA, 38 nt, Artificial Sequence
  Description of Artificial Sequence:  Enzymatic Nucleic Acid
aggucuaucugaugaggccguuaggccgaaauagccag

SEQ ID NO: 659 - RNA, 38 nt, Artificial Sequence
  Description of Artificial Sequence:  Enzymatic Nucleic Acid
cuaagguccugaugaggccguuaggccgaaaugauagc

SEQ ID NO: 660 - RNA, 38 nt, Artificial Sequence
  Description of Artificial Sequence:  Enzymatic Nucleic Acid
cgaagacucugaugaggccguuaggccgaaaggucuau

SEQ ID NO: 661 - RNA, 38 nt, Artificial Sequence
  Description of Artificial Sequence:  Enzymatic Nucleic Acid
gcgaagaccugaugaggccguuaggccgaaaaggucua

SEQ ID NO: 662 - RNA, 38 nt, Artificial Sequence
  Description of Artificial Sequence:  Enzymatic Nucleic Acid
ccagcgaacugaugaggccguuaggccgaaacuaaggu

SEQ ID NO: 663 - RNA, 38 nt, Artificial Sequence
  Description of Artificial Sequence:  Enzymatic Nucleic Acid
uaccagcgcugaugaggccguuaggccgaaagacuaag

SEQ ID NO: 664 - RNA, 38 nt, Artificial Sequence
  Description of Artificial Sequence:  Enzymatic Nucleic Acid
auaccagccugaugaggccguuaggccgaaaagacuaa

SEQ ID NO: 665 - RNA, 38 nt, Artificial Sequence
  Description of Artificial Sequence:  Enzymatic Nucleic Acid
agcgaguacugaugaggccguuaggccgaaaccagcga

SEQ ID NO: 666 - RNA, 38 nt, Artificial Sequence
  Description of Artificial Sequence:  Enzymatic Nucleic Acid
acagcgagcugaugaggccguuaggccgaaauaccagc

SEQ ID NO: 667 - RNA, 38 nt, Artificial Sequence
  Description of Artificial Sequence:  Enzymatic Nucleic Acid
cagacagccugaugaggccguuaggccgaaaguauacc

SEQ ID NO: 668 - RNA, 38 nt, Artificial Sequence
  Description of Artificial Sequence:  Enzymatic Nucleic Acid
gguugacacugaugaggccguuaggccgaaacagcgag

SEQ ID NO: 669 - RNA, 38 nt, Artificial Sequence
  Description of Artificial Sequence:  Enzymatic Nucleic Acid
cgcugguucugaugaggccguuaggccgaaacagacag

SEQ ID NO: 670 - RNA, 38 nt, Artificial Sequence
  Description of Artificial Sequence:  Enzymatic Nucleic Acid
aaaaaguccugaugaggccguuaggccgaaaccgcugg

SEQ ID NO: 671 - RNA, 38 nt, Artificial Sequence
  Description of Artificial Sequence:  Enzymatic Nucleic Acid
cuuaaaaacugaugaggccguuaggccgaaagucaacc

SEQ ID NO: 672 - RNA, 38 nt, Artificial Sequence
  Description of Artificial Sequence:  Enzymatic Nucleic Acid
gcuuaaaacugaugaggccguuaggccgaaaagucaac

SEQ ID NO: 673 - RNA, 38 nt, Artificial Sequence
  Description of Artificial Sequence:  Enzymatic Nucleic Acid
ggcuuaaacugaugaggccguuaggccgaaaaagucaa

SEQ ID NO: 674 - RNA, 38 nt, Artificial Sequence
  Description of Artificial Sequence:  Enzymatic Nucleic Acid
aggcuuaacugaugaggccguuaggccgaaaaaaguca

SEQ ID NO: 675 - RNA, 38 nt, Artificial Sequence
  Description of Artificial Sequence:  Enzymatic Nucleic Acid
aaggcuuacugaugaggccguuaggccgaaaaaaaguc

SEQ ID NO: 676 - RNA, 38 nt, Artificial Sequence
  Description of Artificial Sequence:  Enzymatic Nucleic Acid
gaaggcuucugaugaggccguuaggccgaaaaaaaagu

SEQ ID NO: 677 - RNA, 38 nt, Artificial Sequence
  Description of Artificial Sequence:  Enzymatic Nucleic Acid
agaaggcucugaugaggccguuaggccgaaaaaaaaag

SEQ ID NO: 678 - RNA, 38 nt, Artificial Sequence
  Description of Artificial Sequence:  Enzymatic Nucleic Acid
gaaaaaagcugaugaggccguuaggccgaaaggcuuaa

SEQ ID NO: 679 - RNA, 38 nt, Artificial Sequence
  Description of Artificial Sequence:  Enzymatic Nucleic Acid
agaaaaaacugaugaggccguuaggccgaaaaggcuua

SEQ ID NO: 680 - RNA, 38 nt, Artificial Sequence
  Description of Artificial Sequence:  Enzymatic Nucleic Acid
agagaaaacugaugaggccguuaggccgaaagaaggcu

SEQ ID NO: 681 - RNA, 38 nt, Artificial Sequence
  Description of Artificial Sequence:  Enzymatic Nucleic Acid
aagagaaacugaugaggccguuaggccgaaaagaaggc

SEQ ID NO: 682 - RNA, 38 nt, Artificial Sequence
  Description of Artificial Sequence:  Enzymatic Nucleic Acid
aaagagaacugaugaggccguuaggccgaaaaagaagg

SEQ ID NO: 683 - RNA, 38 nt, Artificial Sequence
  Description of Artificial Sequence:  Enzymatic Nucleic Acid
aaaagagacugaugaggccguuaggccgaaaaaagaag

SEQ ID NO: 684 - RNA, 38 nt, Artificial Sequence
  Description of Artificial Sequence:  Enzymatic Nucleic Acid
uaaaagagcugaugaggccguuaggccgaaaaaaagaa

SEQ ID NO: 685 - RNA, 38 nt, Artificial Sequence
  Description of Artificial Sequence:  Enzymatic Nucleic Acid
guaaaagacugaugaggccguuaggccgaaaaaaaaga

SEQ ID NO: 686 - RNA, 38 nt, Artificial Sequence
  Description of Artificial Sequence:  Enzymatic Nucleic Acid
ugguaaaacugaugaggccguuaggccgaaagaaaaaa

SEQ ID NO: 687 - RNA, 38 nt, Artificial Sequence
  Description of Artificial Sequence:  Enzymatic Nucleic Acid
acugguaacugaugaggccguuaggccgaaagagaaaa

SEQ ID NO: 688 - RNA, 38 nt, Artificial Sequence
  Description of Artificial Sequence:  Enzymatic Nucleic Acid
aacugguacugaugaggccguuaggccgaaaagagaaa

SEQ ID NO: 689 - RNA, 38 nt, Artificial Sequence
  Description of Artificial Sequence:  Enzymatic Nucleic Acid
aaacuggucugaugaggccguuaggccgaaaaagagaa

SEQ ID NO: 690 - RNA, 38 nt, Artificial Sequence
  Description of Artificial Sequence:  Enzymatic Nucleic Acid
gaaacuggcugaugaggccguuaggccgaaaaaagaga

SEQ ID NO: 691 - RNA, 38 nt, Artificial Sequence
  Description of Artificial Sequence:  Enzymatic Nucleic Acid
gcuccagacugaugaggccguuaggccgaaacugguaa

SEQ ID NO: 692 - RNA, 38 nt, Artificial Sequence
  Description of Artificial Sequence:  Enzymatic Nucleic Acid
ugcuccagcugaugaggccguuaggccgaaaacuggua

SEQ ID NO: 693 - RNA, 38 nt, Artificial Sequence
  Description of Artificial Sequence:  Enzymatic Nucleic Acid
uugcuccacugaugaggccguuaggccgaaaaacuggu

SEQ ID NO: 694 - RNA, 38 nt, Artificial Sequence
  Description of Artificial Sequence:  Enzymatic Nucleic Acid
gcaaacugcugaugaggccguuaggccgaaauuugcuc

SEQ ID NO: 695 - RNA, 38 nt, Artificial Sequence
  Description of Artificial Sequence:  Enzymatic Nucleic Acid
ggcaaacucugaugaggccguuaggccgaaaauuugcu

SEQ ID NO: 696 - RNA, 38 nt, Artificial Sequence
  Description of Artificial Sequence:  Enzymatic Nucleic Acid
ggaaggcacugaugaggccguuaggccgaaacugaauu

SEQ ID NO: 697 - RNA, 38 nt, Artificial Sequence
  Description of Artificial Sequence:  Enzymatic Nucleic Acid
aggaaggccugaugaggccguuaggccgaaaacugaau

SEQ ID NO: 698 - RNA, 38 nt, Artificial Sequence
  Description of Artificial Sequence:  Enzymatic Nucleic Acid
aauccaggcugaugaggccguuaggccgaaaggcaaac

SEQ ID NO: 699 - RNA, 38 nt, Artificial Sequence
  Description of Artificial Sequence:  Enzymatic Nucleic Acid
aaauccagcugaugaggccguuaggccgaaaaggcaaa

SEQ ID NO: 700 - RNA, 38 nt, Artificial Sequence
  Description of Artificial Sequence:  Enzymatic Nucleic Acid
aauuuacacugaugaggccguuaggccgaaauccagga

SEQ ID NO: 701 - RNA, 38 nt, Artificial Sequence
  Description of Artificial Sequence:  Enzymatic Nucleic Acid
caauuuaccugaugaggccguuaggccgaaaauccagg

SEQ ID NO: 702 - RNA, 38 nt, Artificial Sequence
  Description of Artificial Sequence:  Enzymatic Nucleic Acid
uuacaauucugaugaggccguuaggccgaaacaaaucc

SEQ ID NO: 703 - RNA, 38 nt, Artificial Sequence
  Description of Artificial Sequence:  Enzymatic Nucleic Acid
gucauuaccugaugaggccguuaggccgaaauuuacaa

SEQ ID NO: 704 - RNA, 38 nt, Artificial Sequence
  Description of Artificial Sequence:  Enzymatic Nucleic Acid
gaggucaucugaugaggccguuaggccgaaacaauuua

SEQ ID NO: 705 - RNA, 38 nt, Artificial Sequence
  Description of Artificial Sequence:  Enzymatic Nucleic Acid
aaaguuuucugaugaggccguuaggccgaaaggucauu

SEQ ID NO: 706 - RNA, 38 nt, Artificial Sequence
  Description of Artificial Sequence:  Enzymatic Nucleic Acid
aacugcuacugaugaggccguuaggccgaaaguuuuga

SEQ ID NO: 707 - RNA, 38 nt, Artificial Sequence
  Description of Artificial Sequence:  Enzymatic Nucleic Acid
gaacugcucugaugaggccguuaggccgaaaaguuuug

SEQ ID NO: 708 - RNA, 38 nt, Artificial Sequence
  Description of Artificial Sequence:  Enzymatic Nucleic Acid
agaacugccugaugaggccguuaggccgaaaaaguuuu

SEQ ID NO: 709 - RNA, 38 nt, Artificial Sequence
  Description of Artificial Sequence:  Enzymatic Nucleic Acid
gauggaagcugaugaggccguuaggccgaaacugcuaa

SEQ ID NO: 710 - RNA, 38 nt, Artificial Sequence
  Description of Artificial Sequence:  Enzymatic Nucleic Acid
agauggaacugaugaggccguuaggccgaaaacugcua

SEQ ID NO: 711 - RNA, 38 nt, Artificial Sequence
  Description of Artificial Sequence:  Enzymatic Nucleic Acid
ucagauggcugaugaggccguuaggccgaaagaacugc

SEQ ID NO: 712 - RNA, 38 nt, Artificial Sequence
  Description of Artificial Sequence:  Enzymatic Nucleic Acid
gucagaugcugaugaggccguuaggccgaaaagaacug

SEQ ID NO: 713 - RNA, 38 nt, Artificial Sequence
  Description of Artificial Sequence:  Enzymatic Nucleic Acid
cugagucacugaugaggccguuaggccgaaauggaaga

SEQ ID NO: 714 - RNA, 38 nt, Artificial Sequence
  Description of Artificial Sequence:  Enzymatic Nucleic Acid
gcaaaccucugaugaggccguuaggccgaaagucagau

SEQ ID NO: 715 - RNA, 38 nt, Artificial Sequence
  Description of Artificial Sequence:  Enzymatic Nucleic Acid
gagaagcacugaugaggccguuaggccgaaaccugagu

SEQ ID NO: 716 - RNA, 38 nt, Artificial Sequence
  Description of Artificial Sequence:  Enzymatic Nucleic Acid
agagaagccugaugaggccguuaggccgaaaaccugag

SEQ ID NO: 717 - RNA, 38 nt, Artificial Sequence
  Description of Artificial Sequence:  Enzymatic Nucleic Acid
cgccagagcugaugaggccguuaggccgaaagcaaacc

SEQ ID NO: 718 - RNA, 38 nt, Artificial Sequence
  Description of Artificial Sequence:  Enzymatic Nucleic Acid
ccgccagacugaugaggccguuaggccgaaaagcaaac

SEQ ID NO: 719 - RNA, 38 nt, Artificial Sequence
  Description of Artificial Sequence:  Enzymatic Nucleic Acid
gaccgccacugaugaggccguuaggccgaaagaagcaa

SEQ ID NO: 720 - RNA, 38 nt, Artificial Sequence
  Description of Artificial Sequence:  Enzymatic Nucleic Acid
auucugaacugaugaggccguuaggccgaaaccgccag

SEQ ID NO: 721 - RNA, 38 nt, Artificial Sequence
  Description of Artificial Sequence:  Enzymatic Nucleic Acid
ugauucugcugaugaggccguuaggccgaaagaccgcc

SEQ ID NO: 722 - RNA, 38 nt, Artificial Sequence
  Description of Artificial Sequence:  Enzymatic Nucleic Acid
uugauucucugaugaggccguuaggccgaaaagaccgc

SEQ ID NO: 723 - RNA, 38 nt, Artificial Sequence
  Description of Artificial Sequence:  Enzymatic Nucleic Acid
uggauguucugaugaggccguuaggccgaaauucugaa

SEQ ID NO: 724 - RNA, 38 nt, Artificial Sequence
  Description of Artificial Sequence:  Enzymatic Nucleic Acid
gaagugugcugaugaggccguuaggccgaaauguugau

SEQ ID NO: 725 - RNA, 38 nt, Artificial Sequence
  Description of Artificial Sequence:  Enzymatic Nucleic Acid
aaucacggcugaugaggccguuaggccgaaagugugga

SEQ ID NO: 726 - RNA, 38 nt, Artificial Sequence
  Description of Artificial Sequence:  Enzymatic Nucleic Acid
uaaucacgcugaugaggccguuaggccgaaaagugugg

SEQ ID NO: 727 - RNA, 38 nt, Artificial Sequence
  Description of Artificial Sequence:  Enzymatic Nucleic Acid
acgcagaucugaugaggccguuaggccgaaaucacgga

SEQ ID NO: 728 - RNA, 38 nt, Artificial Sequence
  Description of Artificial Sequence:  Enzymatic Nucleic Acid
cacgcagacugaugaggccguuaggccgaaaaucacgg

SEQ ID NO: 729 - RNA, 38 nt, Artificial Sequence
  Description of Artificial Sequence:  Enzymatic Nucleic Acid
ugcacgcacugaugaggccguuaggccgaaauaaucac

SEQ ID NO: 730 - RNA, 38 nt, Artificial Sequence
  Description of Artificial Sequence:  Enzymatic Nucleic Acid
uuguccaacugaugaggccguuaggccgaaaugcacgc

SEQ ID NO: 731 - RNA, 38 nt, Artificial Sequence
  Description of Artificial Sequence:  Enzymatic Nucleic Acid
uuuguccacugaugaggccguuaggccgaaaaugcacg

SEQ ID NO: 732 - RNA, 38 nt, Artificial Sequence
  Description of Artificial Sequence:  Enzymatic Nucleic Acid
cuuugucccugaugaggccguuaggccgaaaaaugcac

SEQ ID NO: 733 - RNA, 38 nt, Artificial Sequence
  Description of Artificial Sequence:  Enzymatic Nucleic Acid
cugguuggcugaugaggccguuaggccgaaagcuuugu

SEQ ID NO: 734 - RNA, 38 nt, Artificial Sequence
  Description of Artificial Sequence:  Enzymatic Nucleic Acid
ccugguugcugaugaggccguuaggccgaaaagcuuug

SEQ ID NO: 735 - RNA, 38 nt, Artificial Sequence
  Description of Artificial Sequence:  Enzymatic Nucleic Acid
ucuucccgcugaugaggccguuaggccgaaauccuggu

SEQ ID NO: 736 - RNA, 38 nt, Artificial Sequence
  Description of Artificial Sequence:  Enzymatic Nucleic Acid
ugcugaaacugaugaggccguuaggccgaaaucaccag

SEQ ID NO: 737 - RNA, 38 nt, Artificial Sequence
  Description of Artificial Sequence:  Enzymatic Nucleic Acid
ccugcugacugaugaggccguuaggccgaaagaucacc

SEQ ID NO: 738 - RNA, 38 nt, Artificial Sequence
  Description of Artificial Sequence:  Enzymatic Nucleic Acid
accugcugcugaugaggccguuaggccgaaaagaucac

SEQ ID NO: 739 - RNA, 38 nt, Artificial Sequence
  Description of Artificial Sequence:  Enzymatic Nucleic Acid
aaccugcucugaugaggccguuaggccgaaaaagauca

SEQ ID NO: 740 - RNA, 38 nt, Artificial Sequence
  Description of Artificial Sequence:  Enzymatic Nucleic Acid
caugaagacugaugaggccguuaggccgaaaccugcug

SEQ ID NO: 741 - RNA, 38 nt, Artificial Sequence
  Description of Artificial Sequence:  Enzymatic Nucleic Acid
ccaugaagcugaugaggccguuaggccgaaaaccugcu

SEQ ID NO: 742 - RNA, 38 nt, Artificial Sequence
  Description of Artificial Sequence:  Enzymatic Nucleic Acid
uccaugaacugaugaggccguuaggccgaaaaaccugc

SEQ ID NO: 743 - RNA, 38 nt, Artificial Sequence
  Description of Artificial Sequence:  Enzymatic Nucleic Acid
ccuccaugcugaugaggccguuaggccgaaagaaaccu

SEQ ID NO: 744 - RNA, 38 nt, Artificial Sequence
  Description of Artificial Sequence:  Enzymatic Nucleic Acid
uccuccaucugaugaggccguuaggccgaaaagaaacc

SEQ ID NO: 745 - RNA, 38 nt, Artificial Sequence
  Description of Artificial Sequence:  Enzymatic Nucleic Acid
uauguauucugaugaggccguuaggccgaaaguuccuc

SEQ ID NO: 746 - RNA, 38 nt, Artificial Sequence
  Description of Artificial Sequence:  Enzymatic Nucleic Acid
guauguaucugaugaggccguuaggccgaaaaguuccu

SEQ ID NO: 747 - RNA, 38 nt, Artificial Sequence
  Description of Artificial Sequence:  Enzymatic Nucleic Acid
acgguaugcugaugaggccguuaggccgaaauuaaguu

SEQ ID NO: 748 - RNA, 38 nt, Artificial Sequence
  Description of Artificial Sequence:  Enzymatic Nucleic Acid
ucugacggcugaugaggccguuaggccgaaauguauua

SEQ ID NO: 749 - RNA, 38 nt, Artificial Sequence
  Description of Artificial Sequence:  Enzymatic Nucleic Acid
cugcuucucugaugaggccguuaggccgaaacgguaug

SEQ ID NO: 750 - RNA, 38 nt, Artificial Sequence
  Description of Artificial Sequence:  Enzymatic Nucleic Acid
uuaaguaccugaugaggccguuaggccgaaacucccug

SEQ ID NO: 751 - RNA, 38 nt, Artificial Sequence
  Description of Artificial Sequence:  Enzymatic Nucleic Acid
uauuuaagcugaugaggccguuaggccgaaacuacucc

SEQ ID NO: 752 - RNA, 38 nt, Artificial Sequence
  Description of Artificial Sequence:  Enzymatic Nucleic Acid
ugauauuucugaugaggccguuaggccgaaaguacuac

SEQ ID NO: 753 - RNA, 38 nt, Artificial Sequence
  Description of Artificial Sequence:  Enzymatic Nucleic Acid
uugauauucugaugaggccguuaggccgaaaaguacua

SEQ ID NO: 754 - RNA, 38 nt, Artificial Sequence
  Description of Artificial Sequence:  Enzymatic Nucleic Acid
guucuugacugaugaggccguuaggccgaaauuuaagu

SEQ ID NO: 755 - RNA, 38 nt, Artificial Sequence
  Description of Artificial Sequence:  Enzymatic Nucleic Acid
caguucuucugaugaggccguuaggccgaaauauuuaa

SEQ ID NO: 756 - RNA, 38 nt, Artificial Sequence
  Description of Artificial Sequence:  Enzymatic Nucleic Acid
uccugaaucugaugaggccguuaggccgaaaggcaguu

SEQ ID NO: 757 - RNA, 38 nt, Artificial Sequence
  Description of Artificial Sequence:  Enzymatic Nucleic Acid
agguccugcugaugaggccguuaggccgaaauuaggca

SEQ ID NO: 758 - RNA, 38 nt, Artificial Sequence
  Description of Artificial Sequence:  Enzymatic Nucleic Acid
gagguccucugaugaggccguuaggccgaaaauuaggc

SEQ ID NO: 759 - RNA, 38 nt, Artificial Sequence
  Description of Artificial Sequence:  Enzymatic Nucleic Acid
aucaugugcugaugaggccguuaggccgaaagguccug

SEQ ID NO: 760 - RNA, 38 nt, Artificial Sequence
  Description of Artificial Sequence:  Enzymatic Nucleic Acid
aaaccucccugaugaggccguuaggccgaaaucaugug

SEQ ID NO: 761 - RNA, 38 nt, Artificial Sequence
  Description of Artificial Sequence:  Enzymatic Nucleic Acid
gaaauguacugaugaggccguuaggccgaaaccuccua

SEQ ID NO: 762 - RNA, 38 nt, Artificial Sequence
  Description of Artificial Sequence:  Enzymatic Nucleic Acid
ugaaaugucugaugaggccguuaggccgaaaaccuccu

SEQ ID NO: 763 - RNA, 38 nt, Artificial Sequence
  Description of Artificial Sequence:  Enzymatic Nucleic Acid
uugaaaugcugaugaggccguuaggccgaaaaaccucc

SEQ ID NO: 764 - RNA, 38 nt, Artificial Sequence
  Description of Artificial Sequence:  Enzymatic Nucleic Acid
uaacuugacugaugaggccguuaggccgaaauguaaac

SEQ ID NO: 765 - RNA, 38 nt, Artificial Sequence
  Description of Artificial Sequence:  Enzymatic Nucleic Acid
auaacuugcugaugaggccguuaggccgaaaauguaaa

SEQ ID NO: 766 - RNA, 38 nt, Artificial Sequence
  Description of Artificial Sequence:  Enzymatic Nucleic Acid
uauaacuucugaugaggccguuaggccgaaaaauguaa

SEQ ID NO: 767 - RNA, 38 nt, Artificial Sequence
  Description of Artificial Sequence:  Enzymatic Nucleic Acid
ucuauuaucugaugaggccguuaggccgaaacuugaaa

SEQ ID NO: 768 - RNA, 38 nt, Artificial Sequence
  Description of Artificial Sequence:  Enzymatic Nucleic Acid
aucuauuacugaugaggccguuaggccgaaaacuugaa

SEQ ID NO: 769 - RNA, 38 nt, Artificial Sequence
  Description of Artificial Sequence:  Enzymatic Nucleic Acid
ccaucuaucugaugaggccguuaggccgaaauaacuug

SEQ ID NO: 770 - RNA, 38 nt, Artificial Sequence
  Description of Artificial Sequence:  Enzymatic Nucleic Acid
cuuccauccugaugaggccguuaggccgaaauuauaac

SEQ ID NO: 771 - RNA, 38 nt, Artificial Sequence
  Description of Artificial Sequence:  Enzymatic Nucleic Acid
cuucuggacugaugaggccguuaggccgaaauucucuu

SEQ ID NO: 772 - RNA, 38 nt, Artificial Sequence
  Description of Artificial Sequence:  Enzymatic Nucleic Acid
ccuucuggcugaugaggccguuaggccgaaaauucucu

SEQ ID NO: 773 - RNA, 38 nt, Artificial Sequence
  Description of Artificial Sequence:  Enzymatic Nucleic Acid
accuucugcugaugaggccguuaggccgaaaaauucuc

SEQ ID NO: 774 - RNA, 38 nt, Artificial Sequence
  Description of Artificial Sequence:  Enzymatic Nucleic Acid
cuuugauccugaugaggccguuaggccgaaaccuucac

SEQ ID NO: 775 - RNA, 38 nt, Artificial Sequence
  Description of Artificial Sequence:  Enzymatic Nucleic Acid
ccuucuuucugaugaggccguuaggccgaaaucuaccu

SEQ ID NO: 776 - RNA, 38 nt, Artificial Sequence
  Description of Artificial Sequence:  Enzymatic Nucleic Acid
caacagcucugaugaggccguuaggccgaaauuuggcu

SEQ ID NO: 777 - RNA, 38 nt, Artificial Sequence
  Description of Artificial Sequence:  Enzymatic Nucleic Acid
ucaacagccugaugaggccguuaggccgaaaauuuggc

SEQ ID NO: 778 - RNA, 38 nt, Artificial Sequence
  Description of Artificial Sequence:  Enzymatic Nucleic Acid
aguaucuccugaugaggccguuaggccgaaacagcuaa

SEQ ID NO: 779 - RNA, 38 nt, Artificial Sequence
  Description of Artificial Sequence:  Enzymatic Nucleic Acid
uuauuaagcugaugaggccguuaggccgaaaucucaac

SEQ ID NO: 780 - RNA, 38 nt, Artificial Sequence
  Description of Artificial Sequence:  Enzymatic Nucleic Acid
uccuuauucugaugaggccguuaggccgaaaguaucuc

SEQ ID NO: 781 - RNA, 38 nt, Artificial Sequence
  Description of Artificial Sequence:  Enzymatic Nucleic Acid
uuccuuaucugaugaggccguuaggccgaaaaguaucu

SEQ ID NO: 782 - RNA, 38 nt, Artificial Sequence
  Description of Artificial Sequence:  Enzymatic Nucleic Acid
cuuuuccucugaugaggccguuaggccgaaauuaagua

SEQ ID NO: 783 - RNA, 38 nt, Artificial Sequence
  Description of Artificial Sequence:  Enzymatic Nucleic Acid
aaaggacucugaugaggccguuaggccgaaacugccuu

SEQ ID NO: 784 - RNA, 38 nt, Artificial Sequence
  Description of Artificial Sequence:  Enzymatic Nucleic Acid
uaaaggaccugaugaggccguuaggccgaaaacugccu

SEQ ID NO: 785 - RNA, 38 nt, Artificial Sequence
  Description of Artificial Sequence:  Enzymatic Nucleic Acid
uaauaaagcugaugaggccguuaggccgaaacuaacug

SEQ ID NO: 786 - RNA, 38 nt, Artificial Sequence
  Description of Artificial Sequence:  Enzymatic Nucleic Acid
caauaauacugaugaggccguuaggccgaaaggacuaa

SEQ ID NO: 787 - RNA, 38 nt, Artificial Sequence
  Description of Artificial Sequence:  Enzymatic Nucleic Acid
ucaauaaucugaugaggccguuaggccgaaaaggacua

SEQ ID NO: 788 - RNA, 38 nt, Artificial Sequence
  Description of Artificial Sequence:  Enzymatic Nucleic Acid
gucaauaacugaugaggccguuaggccgaaaaaggacu

SEQ ID NO: 789 - RNA, 38 nt, Artificial Sequence
  Description of Artificial Sequence:  Enzymatic Nucleic Acid
uugucaaucugaugaggccguuaggccgaaauaaagga

SEQ ID NO: 790 - RNA, 38 nt, Artificial Sequence
  Description of Artificial Sequence:  Enzymatic Nucleic Acid
guugucaacugaugaggccguuaggccgaaaauaaagg

SEQ ID NO: 791 - RNA, 38 nt, Artificial Sequence
  Description of Artificial Sequence:  Enzymatic Nucleic Acid
uuguuguccugaugaggccguuaggccgaaauaauaaa

SEQ ID NO: 792 - RNA, 38 nt, Artificial Sequence
  Description of Artificial Sequence:  Enzymatic Nucleic Acid
uucugaagcugaugaggccguuaggccgaaauucguug

SEQ ID NO: 793 - RNA, 38 nt, Artificial Sequence
  Description of Artificial Sequence:  Enzymatic Nucleic Acid
cuucugaacugaugaggccguuaggccgaaaauucguu

SEQ ID NO: 794 - RNA, 38 nt, Artificial Sequence
  Description of Artificial Sequence:  Enzymatic Nucleic Acid
uccuucugcugaugaggccguuaggccgaaagaauucg

SEQ ID NO: 795 - RNA, 38 nt, Artificial Sequence
  Description of Artificial Sequence:  Enzymatic Nucleic Acid
auccuucucugaugaggccguuaggccgaaaagaauuc

SEQ ID NO: 796 - RNA, 38 nt, Artificial Sequence
  Description of Artificial Sequence:  Enzymatic Nucleic Acid
ccauggaucugaugaggccguuaggccgaaauccuucu

SEQ ID NO: 797 - RNA, 38 nt, Artificial Sequence
  Description of Artificial Sequence:  Enzymatic Nucleic Acid
cccauggacugaugaggccguuaggccgaaaauccuuc

SEQ ID NO: 798 - RNA, 38 nt, Artificial Sequence
  Description of Artificial Sequence:  Enzymatic Nucleic Acid
uccccaugcugaugaggccguuaggccgaaauaauccu

SEQ ID NO: 799 - RNA, 38 nt, Artificial Sequence
  Description of Artificial Sequence:  Enzymatic Nucleic Acid
gccuaugucugaugaggccguuaggccgaaauucccca

SEQ ID NO: 800 - RNA, 38 nt, Artificial Sequence
  Description of Artificial Sequence:  Enzymatic Nucleic Acid
ggccuaugcugaugaggccguuaggccgaaaauucccc

SEQ ID NO: 801 - RNA, 38 nt, Artificial Sequence
  Description of Artificial Sequence:  Enzymatic Nucleic Acid
auaaggcccugaugaggccguuaggccgaaauguaauu

SEQ ID NO: 802 - RNA, 38 nt, Artificial Sequence
  Description of Artificial Sequence:  Enzymatic Nucleic Acid
cuauugaucugaugaggccguuaggccgaaaggccuau

SEQ ID NO: 803 - RNA, 38 nt, Artificial Sequence
  Description of Artificial Sequence:  Enzymatic Nucleic Acid
ucuauugacugaugaggccguuaggccgaaaaggccua

SEQ ID NO: 804 - RNA, 38 nt, Artificial Sequence
  Description of Artificial Sequence:  Enzymatic Nucleic Acid
auucuauucugaugaggccguuaggccgaaauaaggcc

SEQ ID NO: 805 - RNA, 38 nt, Artificial Sequence
  Description of Artificial Sequence:  Enzymatic Nucleic Acid
ggcaauuccugaugaggccguuaggccgaaauugauaa

SEQ ID NO: 806 - RNA, 38 nt, Artificial Sequence
  Description of Artificial Sequence:  Enzymatic Nucleic Acid
uucugggccugaugaggccguuaggccgaaauucuauu

SEQ ID NO: 807 - RNA, 38 nt, Artificial Sequence
  Description of Artificial Sequence:  Enzymatic Nucleic Acid
uuuacagucugaugaggccguuaggccgaaagucuuuu

SEQ ID NO: 808 - RNA, 38 nt, Artificial Sequence
  Description of Artificial Sequence:  Enzymatic Nucleic Acid
ucauaauucugaugaggccguuaggccgaaacaguuag

SEQ ID NO: 809 - RNA, 38 nt, Artificial Sequence
  Description of Artificial Sequence:  Enzymatic Nucleic Acid
cuguucaucugaugaggccguuaggccgaaauuuacag

SEQ ID NO: 810 - RNA, 38 nt, Artificial Sequence
  Description of Artificial Sequence:  Enzymatic Nucleic Acid
acuguucacugaugaggccguuaggccgaaaauuuaca

SEQ ID NO: 811 - RNA, 38 nt, Artificial Sequence
  Description of Artificial Sequence:  Enzymatic Nucleic Acid
gcaccccccugaugaggccguuaggccgaaaugcacac

SEQ ID NO: 812 - RNA, 38 nt, Artificial Sequence
  Description of Artificial Sequence:  Enzymatic Nucleic Acid
uauaaugacugaugaggccguuaggccgaaauccuucu

SEQ ID NO: 813 - RNA, 38 nt, Artificial Sequence
  Description of Artificial Sequence:  Enzymatic Nucleic Acid
uuauaaugcugaugaggccguuaggccgaaaauccuuc

SEQ ID NO: 814 - RNA, 38 nt, Artificial Sequence
  Description of Artificial Sequence:  Enzymatic Nucleic Acid
uuuauaaucugaugaggccguuaggccgaaaaauccuu

SEQ ID NO: 815 - RNA, 38 nt, Artificial Sequence
  Description of Artificial Sequence:  Enzymatic Nucleic Acid
gcauuuaucugaugaggccguuaggccgaaaugaaauc

SEQ ID NO: 816 - RNA, 38 nt, Artificial Sequence
  Description of Artificial Sequence:  Enzymatic Nucleic Acid
ugcauuuacugaugaggccguuaggccgaaaaugaaau

SEQ ID NO: 817 - RNA, 38 nt, Artificial Sequence
  Description of Artificial Sequence:  Enzymatic Nucleic Acid
uuugcauucugaugaggccguuaggccgaaauaaugaa

SEQ ID NO: 818 - RNA, 38 nt, Artificial Sequence
  Description of Artificial Sequence:  Enzymatic Nucleic Acid
caauacuacugaugaggccguuaggccgaaauucuuuc

SEQ ID NO: 819 - RNA, 38 nt, Artificial Sequence
  Description of Artificial Sequence:  Enzymatic Nucleic Acid
accaauaccugaugaggccguuaggccgaaauauucuu

SEQ ID NO: 820 - RNA, 38 nt, Artificial Sequence
  Description of Artificial Sequence:  Enzymatic Nucleic Acid
uguaccaacugaugaggccguuaggccgaaacuauauu

SEQ ID NO: 821 - RNA, 38 nt, Artificial Sequence
  Description of Artificial Sequence:  Enzymatic Nucleic Acid
ccuguacccugaugaggccguuaggccgaaauacuaua

SEQ ID NO: 822 - RNA, 38 nt, Artificial Sequence
  Description of Artificial Sequence:  Enzymatic Nucleic Acid
agaaccugcugaugaggccguuaggccgaaaccaauac

SEQ ID NO: 823 - RNA, 38 nt, Artificial Sequence
  Description of Artificial Sequence:  Enzymatic Nucleic Acid
uuuaguagcugaugaggccguuaggccgaaaccuguac

SEQ ID NO: 824 - RNA, 38 nt, Artificial Sequence
  Description of Artificial Sequence:  Enzymatic Nucleic Acid
guuuaguacugaugaggccguuaggccgaaaaccugua

SEQ ID NO: 825 - RNA, 38 nt, Artificial Sequence
  Description of Artificial Sequence:  Enzymatic Nucleic Acid
cuguuuagcugaugaggccguuaggccgaaagaaccug

SEQ ID NO: 826 - RNA, 38 nt, Artificial Sequence
  Description of Artificial Sequence:  Enzymatic Nucleic Acid
uuccuguucugaugaggccguuaggccgaaaguagaac

SEQ ID NO: 827 - RNA, 38 nt, Artificial Sequence
  Description of Artificial Sequence:  Enzymatic Nucleic Acid
uagcggcccugaugaggccguuaggccgaaauuguuuu

SEQ ID NO: 828 - RNA, 38 nt, Artificial Sequence
  Description of Artificial Sequence:  Enzymatic Nucleic Acid
ugcaaguucugaugaggccguuaggccgaaagcggcca

SEQ ID NO: 829 - RNA, 38 nt, Artificial Sequence
  Description of Artificial Sequence:  Enzymatic Nucleic Acid
agauaugccugaugaggccguuaggccgaaaguuuagc

SEQ ID NO: 830 - RNA, 38 nt, Artificial Sequence
  Description of Artificial Sequence:  Enzymatic Nucleic Acid
ucugaagacugaugaggccguuaggccgaaaugcaagu

SEQ ID NO: 831 - RNA, 38 nt, Artificial Sequence
  Description of Artificial Sequence:  Enzymatic Nucleic Acid
uaucugaacugaugaggccguuaggccgaaauaugcaa

SEQ ID NO: 832 - RNA, 38 nt, Artificial Sequence
  Description of Artificial Sequence:  Enzymatic Nucleic Acid
aauaucugcugaugaggccguuaggccgaaagauaugc

SEQ ID NO: 833 - RNA, 38 nt, Artificial Sequence
  Description of Artificial Sequence:  Enzymatic Nucleic Acid
uaauaucucugaugaggccguuaggccgaaaagauaug

SEQ ID NO: 834 - RNA, 38 nt, Artificial Sequence
  Description of Artificial Sequence:  Enzymatic Nucleic Acid
ucugauaacugaugaggccguuaggccgaaaucugaag

SEQ ID NO: 835 - RNA, 38 nt, Artificial Sequence
  Description of Artificial Sequence:  Enzymatic Nucleic Acid
cuucugaucugaugaggccguuaggccgaaauaucuga

SEQ ID NO: 836 - RNA, 38 nt, Artificial Sequence
  Description of Artificial Sequence:  Enzymatic Nucleic Acid
ucuucugacugaugaggccguuaggccgaaaauaucug

SEQ ID NO: 837 - RNA, 38 nt, Artificial Sequence
  Description of Artificial Sequence:  Enzymatic Nucleic Acid
uuucuucucugaugaggccguuaggccgaaauaauauc

SEQ ID NO: 838 - RNA, 38 nt, Artificial Sequence
  Description of Artificial Sequence:  Enzymatic Nucleic Acid
auuucacucugaugaggccguuaggccgaaagguuucu

SEQ ID NO: 839 - RNA, 38 nt, Artificial Sequence
  Description of Artificial Sequence:  Enzymatic Nucleic Acid
gguagucacugaugaggccguuaggccgaaauuucacu

SEQ ID NO: 840 - RNA, 38 nt, Artificial Sequence
  Description of Artificial Sequence:  Enzymatic Nucleic Acid
aggacaggcugaugaggccguuaggccgaaagucagau

SEQ ID NO: 841 - RNA, 38 nt, Artificial Sequence
  Description of Artificial Sequence:  Enzymatic Nucleic Acid
aaccagagcugaugaggccguuaggccgaaacagguag

SEQ ID NO: 842 - RNA, 38 nt, Artificial Sequence
  Description of Artificial Sequence:  Enzymatic Nucleic Acid
aagaaccacugaugaggccguuaggccgaaaggacagg

SEQ ID NO: 843 - RNA, 38 nt, Artificial Sequence
  Description of Artificial Sequence:  Enzymatic Nucleic Acid
agcaaaagcugaugaggccguuaggccgaaaccagagg

SEQ ID NO: 844 - RNA, 38 nt, Artificial Sequence
  Description of Artificial Sequence:  Enzymatic Nucleic Acid
uagcaaaacugaugaggccguuaggccgaaaaccagag

SEQ ID NO: 845 - RNA, 38 nt, Artificial Sequence
  Description of Artificial Sequence:  Enzymatic Nucleic Acid
aguagcaacugaugaggccguuaggccgaaagaaccag

SEQ ID NO: 846 - RNA, 38 nt, Artificial Sequence
  Description of Artificial Sequence:  Enzymatic Nucleic Acid
uaguagcacugaugaggccguuaggccgaaaagaacca

SEQ ID NO: 847 - RNA, 38 nt, Artificial Sequence
  Description of Artificial Sequence:  Enzymatic Nucleic Acid
guaguagccugaugaggccguuaggccgaaaaagaacc

SEQ ID NO: 848 - RNA, 38 nt, Artificial Sequence
  Description of Artificial Sequence:  Enzymatic Nucleic Acid
acacguagcugaugaggccguuaggccgaaagcaaaag

SEQ ID NO: 849 - RNA, 38 nt, Artificial Sequence
  Description of Artificial Sequence:  Enzymatic Nucleic Acid
cucacacgcugaugaggccguuaggccgaaaguagcaa

SEQ ID NO: 850 - RNA, 38 nt, Artificial Sequence
  Description of Artificial Sequence:  Enzymatic Nucleic Acid
ugcuuuggcugaugaggccguuaggccgaaacucacac

SEQ ID NO: 851 - RNA, 38 nt, Artificial Sequence
  Description of Artificial Sequence:  Enzymatic Nucleic Acid
ucacuaaacugaugaggccguuaggccgaaaguugcuu

SEQ ID NO: 852 - RNA, 38 nt, Artificial Sequence
  Description of Artificial Sequence:  Enzymatic Nucleic Acid
ggucacuacugaugaggccguuaggccgaaagaguugc

SEQ ID NO: 853 - RNA, 38 nt, Artificial Sequence
  Description of Artificial Sequence:  Enzymatic Nucleic Acid
uggucacucugaugaggccguuaggccgaaaagaguug

SEQ ID NO: 854 - RNA, 38 nt, Artificial Sequence
  Description of Artificial Sequence:  Enzymatic Nucleic Acid
cuggucaccugaugaggccguuaggccgaaaaagaguu

SEQ ID NO: 855 - RNA, 38 nt, Artificial Sequence
  Description of Artificial Sequence:  Enzymatic Nucleic Acid
ucagaagccugaugaggccguuaggccgaaagugugcu

SEQ ID NO: 856 - RNA, 38 nt, Artificial Sequence
  Description of Artificial Sequence:  Enzymatic Nucleic Acid
ugauucagcugaugaggccguuaggccgaaagcgagug

SEQ ID NO: 857 - RNA, 38 nt, Artificial Sequence
  Description of Artificial Sequence:  Enzymatic Nucleic Acid
augauucacugaugaggccguuaggccgaaaagcgagu

SEQ ID NO: 858 - RNA, 38 nt, Artificial Sequence
  Description of Artificial Sequence:  Enzymatic Nucleic Acid
cagaugaucugaugaggccguuaggccgaaauucagaa

SEQ ID NO: 859 - RNA, 38 nt, Artificial Sequence
  Description of Artificial Sequence:  Enzymatic Nucleic Acid
cuucagaucugaugaggccguuaggccgaaaugauuca

SEQ ID NO: 860 - RNA, 38 nt, Artificial Sequence
  Description of Artificial Sequence:  Enzymatic Nucleic Acid
caccuucacugaugaggccguuaggccgaaaugaugau

SEQ ID NO: 861 - RNA, 38 nt, Artificial Sequence
  Description of Artificial Sequence:  Enzymatic Nucleic Acid
cugcugagcugaugaggccguuaggccgaaagucaccu

SEQ ID NO: 862 - RNA, 38 nt, Artificial Sequence
  Description of Artificial Sequence:  Enzymatic Nucleic Acid
ucugcugacugaugaggccguuaggccgaaaagucacc

SEQ ID NO: 863 - RNA, 38 nt, Artificial Sequence
  Description of Artificial Sequence:  Enzymatic Nucleic Acid
uaucugcucugaugaggccguuaggccgaaagaaguca

SEQ ID NO: 864 - RNA, 38 nt, Artificial Sequence
  Description of Artificial Sequence:  Enzymatic Nucleic Acid
cucugaugcugaugaggccguuaggccgaaaucugcug

SEQ ID NO: 865 - RNA, 38 nt, Artificial Sequence
  Description of Artificial Sequence:  Enzymatic Nucleic Acid
uuaucucucugaugaggccguuaggccgaaauguaucu

SEQ ID NO: 866 - RNA, 38 nt, Artificial Sequence
  Description of Artificial Sequence:  Enzymatic Nucleic Acid
uuagaauucugaugaggccguuaggccgaaaucucuga

SEQ ID NO: 867 - RNA, 38 nt, Artificial Sequence
  Description of Artificial Sequence:  Enzymatic Nucleic Acid
acuguuagcugaugaggccguuaggccgaaauuuaucu

SEQ ID NO: 868 - RNA, 38 nt, Artificial Sequence
  Description of Artificial Sequence:  Enzymatic Nucleic Acid
cacuguuacugaugaggccguuaggccgaaaauuuauc

SEQ ID NO: 869 - RNA, 38 nt, Artificial Sequence
  Description of Artificial Sequence:  Enzymatic Nucleic Acid
gucacugucugaugaggccguuaggccgaaagaauuua

SEQ ID NO: 870 - RNA, 38 nt, Artificial Sequence
  Description of Artificial Sequence:  Enzymatic Nucleic Acid
acuguuuacugaugaggccguuaggccgaaacugucac

SEQ ID NO: 871 - RNA, 38 nt, Artificial Sequence
  Description of Artificial Sequence:  Enzymatic Nucleic Acid
aacuguuucugaugaggccguuaggccgaaaacuguca

SEQ ID NO: 872 - RNA, 38 nt, Artificial Sequence
  Description of Artificial Sequence:  Enzymatic Nucleic Acid
gaacuguucugaugaggccguuaggccgaaaaacuguc

SEQ ID NO: 873 - RNA, 38 nt, Artificial Sequence
  Description of Artificial Sequence:  Enzymatic Nucleic Acid
caacgaagcugaugaggccguuaggccgaaacuguuua

SEQ ID NO: 874 - RNA, 38 nt, Artificial Sequence
  Description of Artificial Sequence:  Enzymatic Nucleic Acid
gcaacgaacugaugaggccguuaggccgaaaacuguuu

SEQ ID NO: 875 - RNA, 38 nt, Artificial Sequence
  Description of Artificial Sequence:  Enzymatic Nucleic Acid
aagcaacgcugaugaggccguuaggccgaaagaacugu

SEQ ID NO: 876 - RNA, 38 nt, Artificial Sequence
  Description of Artificial Sequence:  Enzymatic Nucleic Acid
uaagcaaccugaugaggccguuaggccgaaaagaacug

SEQ ID NO: 877 - RNA, 38 nt, Artificial Sequence
  Description of Artificial Sequence:  Enzymatic Nucleic Acid
ucauaagccugaugaggccguuaggccgaaacgaagaa

SEQ ID NO: 878 - RNA, 38 nt, Artificial Sequence
  Description of Artificial Sequence:  Enzymatic Nucleic Acid
ccauucaucugaugaggccguuaggccgaaagcaacga

SEQ ID NO: 879 - RNA, 38 nt, Artificial Sequence
  Description of Artificial Sequence:  Enzymatic Nucleic Acid
accauucacugaugaggccguuaggccgaaaagcaacg

SEQ ID NO: 880 - RNA, 38 nt, Artificial Sequence
  Description of Artificial Sequence:  Enzymatic Nucleic Acid
auuucugacugaugaggccguuaggccgaaaccauuca

SEQ ID NO: 881 - RNA, 38 nt, Artificial Sequence
  Description of Artificial Sequence:  Enzymatic Nucleic Acid
uuauuucucugaugaggccguuaggccgaaagaccauu

SEQ ID NO: 882 - RNA, 38 nt, Artificial Sequence
  Description of Artificial Sequence:  Enzymatic Nucleic Acid
ccuuugaucugaugaggccguuaggccgaaauuucuga

SEQ ID NO: 883 - RNA, 38 nt, Artificial Sequence
  Description of Artificial Sequence:  Enzymatic Nucleic Acid
cuuccuuucugaugaggccguuaggccgaaauuauuuc

SEQ ID NO: 884 - RNA, 38 nt, Artificial Sequence
  Description of Artificial Sequence:  Enzymatic Nucleic Acid
gugccaaacugaugaggccguuaggccgaaaucuuuuu

SEQ ID NO: 885 - RNA, 38 nt, Artificial Sequence
  Description of Artificial Sequence:  Enzymatic Nucleic Acid
gggugccacugaugaggccguuaggccgaaagaucuuu

SEQ ID NO: 886 - RNA, 38 nt, Artificial Sequence
  Description of Artificial Sequence:  Enzymatic Nucleic Acid
ugggugcccugaugaggccguuaggccgaaaagaucuu

SEQ ID NO: 887 - RNA, 38 nt, Artificial Sequence
  Description of Artificial Sequence:  Enzymatic Nucleic Acid
gaaggucacugaugaggccguuaggccgaaaucugggu

SEQ ID NO: 888 - RNA, 38 nt, Artificial Sequence
  Description of Artificial Sequence:  Enzymatic Nucleic Acid
ggaagguccugaugaggccguuaggccgaaaaucuggg

SEQ ID NO: 889 - RNA, 38 nt, Artificial Sequence
  Description of Artificial Sequence:  Enzymatic Nucleic Acid
augucaggcugaugaggccguuaggccgaaaggucaaa

SEQ ID NO: 890 - RNA, 38 nt, Artificial Sequence
  Description of Artificial Sequence:  Enzymatic Nucleic Acid
caugucagcugaugaggccguuaggccgaaaaggucaa

SEQ ID NO: 891 - RNA, 38 nt, Artificial Sequence
  Description of Artificial Sequence:  Enzymatic Nucleic Acid
ccacaguacugaugaggccguuaggccgaaacuuuguu

SEQ ID NO: 892 - RNA, 38 nt, Artificial Sequence
  Description of Artificial Sequence:  Enzymatic Nucleic Acid
guccacagcugaugaggccguuaggccgaaauacuuug

SEQ ID NO: 893 - RNA, 38 nt, Artificial Sequence
  Description of Artificial Sequence:  Enzymatic Nucleic Acid
ccaugccacugaugaggccguuaggccgaaaccucuug

SEQ ID NO: 894 - RNA, 38 nt, Artificial Sequence
  Description of Artificial Sequence:  Enzymatic Nucleic Acid
uccaugcccugaugaggccguuaggccgaaaaccucuu

SEQ ID NO: 895 - RNA, 38 nt, Artificial Sequence
  Description of Artificial Sequence:  Enzymatic Nucleic Acid
uucuuuaacugaugaggccguuaggccgaaauccaugc

SEQ ID NO: 896 - RNA, 38 nt, Artificial Sequence
  Description of Artificial Sequence:  Enzymatic Nucleic Acid
uuucuuuacugaugaggccguuaggccgaaaauccaug

SEQ ID NO: 897 - RNA, 38 nt, Artificial Sequence
  Description of Artificial Sequence:  Enzymatic Nucleic Acid
auuucuuucugaugaggccguuaggccgaaaaauccau

SEQ ID NO: 898 - RNA, 38 nt, Artificial Sequence
  Description of Artificial Sequence:  Enzymatic Nucleic Acid
uauuucuucugaugaggccguuaggccgaaaaaaucca

SEQ ID NO: 899 - RNA, 38 nt, Artificial Sequence
  Description of Artificial Sequence:  Enzymatic Nucleic Acid
auuaauuccugaugaggccguuaggccgaaauuucuuu

SEQ ID NO: 900 - RNA, 38 nt, Artificial Sequence
  Description of Artificial Sequence:  Enzymatic Nucleic Acid
agccaauucugaugaggccguuaggccgaaauucuauu

SEQ ID NO: 901 - RNA, 38 nt, Artificial Sequence
  Description of Artificial Sequence:  Enzymatic Nucleic Acid
gagccaaucugaugaggccguuaggccgaaaauucuau

SEQ ID NO: 902 - RNA, 38 nt, Artificial Sequence
  Description of Artificial Sequence:  Enzymatic Nucleic Acid
ccugagcccugaugaggccguuaggccgaaauuaauuc

SEQ ID NO: 903 - RNA, 38 nt, Artificial Sequence
  Description of Artificial Sequence:  Enzymatic Nucleic Acid
auccaccucugaugaggccguuaggccgaaagccaauu

SEQ ID NO: 904 - RNA, 38 nt, Artificial Sequence
  Description of Artificial Sequence:  Enzymatic Nucleic Acid
cuuggccacugaugaggccguuaggccgaaauccaccu

SEQ ID NO: 905 - RNA, 38 nt, Artificial Sequence
  Description of Artificial Sequence:  Enzymatic Nucleic Acid
acuuggcccugaugaggccguuaggccgaaaauccacc

SEQ ID NO: 906 - RNA, 38 nt, Artificial Sequence
  Description of Artificial Sequence:  Enzymatic Nucleic Acid
gcuuugaacugaugaggccguuaggccgaaacuuggcc

SEQ ID NO: 907 - RNA, 38 nt, Artificial Sequence
  Description of Artificial Sequence:  Enzymatic Nucleic Acid
ugcuuugacugaugaggccguuaggccgaaaacuuggc

SEQ ID NO: 908 - RNA, 38 nt, Artificial Sequence
  Description of Artificial Sequence:  Enzymatic Nucleic Acid
uugcuuugcugaugaggccguuaggccgaaaaacuugg

SEQ ID NO: 909 - RNA, 38 nt, Artificial Sequence
  Description of Artificial Sequence:  Enzymatic Nucleic Acid
uuugcuuucugaugaggccguuaggccgaaaaaacuug

SEQ ID NO: 910 - RNA, 38 nt, Artificial Sequence
  Description of Artificial Sequence:  Enzymatic Nucleic Acid
uuuccguccugaugaggccguuaggccgaaauucugug

SEQ ID NO: 911 - RNA, 38 nt, Artificial Sequence
  Description of Artificial Sequence:  Enzymatic Nucleic Acid
aauaacgucugaugaggccguuaggccgaaagucuuuc

SEQ ID NO: 912 - RNA, 38 nt, Artificial Sequence
  Description of Artificial Sequence:  Enzymatic Nucleic Acid
uaauaacgcugaugaggccguuaggccgaaaagucuuu

SEQ ID NO: 913 - RNA, 38 nt, Artificial Sequence
  Description of Artificial Sequence:  Enzymatic Nucleic Acid
cguuuaaucugaugaggccguuaggccgaaacguaagu

SEQ ID NO: 914 - RNA, 38 nt, Artificial Sequence
  Description of Artificial Sequence:  Enzymatic Nucleic Acid
acguuuaacugaugaggccguuaggccgaaaacguaag

SEQ ID NO: 915 - RNA, 38 nt, Artificial Sequence
  Description of Artificial Sequence:  Enzymatic Nucleic Acid
acacguuucugaugaggccguuaggccgaaauaacgua

SEQ ID NO: 916 - RNA, 38 nt, Artificial Sequence
  Description of Artificial Sequence:  Enzymatic Nucleic Acid
aacacguucugaugaggccguuaggccgaaaauaacgu

SEQ ID NO: 917 - RNA, 38 nt, Artificial Sequence
  Description of Artificial Sequence:  Enzymatic Nucleic Acid
uuauauuucugaugaggccguuaggccgaaacacguuu

SEQ ID NO: 918 - RNA, 38 nt, Artificial Sequence
  Description of Artificial Sequence:  Enzymatic Nucleic Acid
auuauauucugaugaggccguuaggccgaaaacacguu

SEQ ID NO: 919 - RNA, 38 nt, Artificial Sequence
  Description of Artificial Sequence:  Enzymatic Nucleic Acid
cguuauuacugaugaggccguuaggccgaaauuuaaca

SEQ ID NO: 920 - RNA, 38 nt, Artificial Sequence
  Description of Artificial Sequence:  Enzymatic Nucleic Acid
cucguuaucugaugaggccguuaggccgaaauauuuaa

SEQ ID NO: 921 - RNA, 38 nt, Artificial Sequence
  Description of Artificial Sequence:  Enzymatic Nucleic Acid
cuucucgucugaugaggccguuaggccgaaauuauauu

SEQ ID NO: 922 - RNA, 38 nt, Artificial Sequence
  Description of Artificial Sequence:  Enzymatic Nucleic Acid
aaugcuuucugaugaggccguuaggccgaaacuucacg

SEQ ID NO: 923 - RNA, 38 nt, Artificial Sequence
  Description of Artificial Sequence:  Enzymatic Nucleic Acid
guuuugcccugaugaggccguuaggccgaaaugcuuuu

SEQ ID NO: 924 - RNA, 38 nt, Artificial Sequence
  Description of Artificial Sequence:  Enzymatic Nucleic Acid
acaugauccugaugaggccguuaggccgaaaguuuugc

SEQ ID NO: 925 - RNA, 38 nt, Artificial Sequence
  Description of Artificial Sequence:  Enzymatic Nucleic Acid
auuuacaucugaugaggccguuaggccgaaaucaaguu

SEQ ID NO: 926 - RNA, 38 nt, Artificial Sequence
  Description of Artificial Sequence:  Enzymatic Nucleic Acid
acaauauucugaugaggccguuaggccgaaacaugauc

SEQ ID NO: 927 - RNA, 38 nt, Artificial Sequence
  Description of Artificial Sequence:  Enzymatic Nucleic Acid
gugaacaacugaugaggccguuaggccgaaauuuacau

SEQ ID NO: 928 - RNA, 38 nt, Artificial Sequence
  Description of Artificial Sequence:  Enzymatic Nucleic Acid
uagugaaccugaugaggccguuaggccgaaauauuuac

SEQ ID NO: 929 - RNA, 38 nt, Artificial Sequence
  Description of Artificial Sequence:  Enzymatic Nucleic Acid
uuguagugcugaugaggccguuaggccgaaacaauauu

SEQ ID NO: 930 - RNA, 38 nt, Artificial Sequence
  Description of Artificial Sequence:  Enzymatic Nucleic Acid
auuguagucugaugaggccguuaggccgaaaacaauau

SEQ ID NO: 931 - RNA, 38 nt, Artificial Sequence
  Description of Artificial Sequence:  Enzymatic Nucleic Acid
agccauugcugaugaggccguuaggccgaaagugaaca

SEQ ID NO: 932 - RNA, 38 nt, Artificial Sequence
  Description of Artificial Sequence:  Enzymatic Nucleic Acid
uccauccccugaugaggccguuaggccgaaacagccau

SEQ ID NO: 933 - RNA, 38 nt, Artificial Sequence
  Description of Artificial Sequence:  Enzymatic Nucleic Acid
cauaaucacugaugaggccguuaggccgaaauccaucc

SEQ ID NO: 934 - RNA, 38 nt, Artificial Sequence
  Description of Artificial Sequence:  Enzymatic Nucleic Acid
ucauaauccugaugaggccguuaggccgaaaauccauc

SEQ ID NO: 935 - RNA, 38 nt, Artificial Sequence
  Description of Artificial Sequence:  Enzymatic Nucleic Acid
aggaucaucugaugaggccguuaggccgaaaucaaauc

SEQ ID NO: 936 - RNA, 38 nt, Artificial Sequence
  Description of Artificial Sequence:  Enzymatic Nucleic Acid
caggaucacugaugaggccguuaggccgaaaaucaaau

SEQ ID NO: 937 - RNA, 38 nt, Artificial Sequence
  Description of Artificial Sequence:  Enzymatic Nucleic Acid
ggucucagcugaugaggccguuaggccgaaaucauaau

SEQ ID NO: 938 - RNA, 38 nt, Artificial Sequence
  Description of Artificial Sequence:  Enzymatic Nucleic Acid
cucaagagcugaugaggccguuaggccgaaaucaucac

SEQ ID NO: 939 - RNA, 38 nt, Artificial Sequence
  Description of Artificial Sequence:  Enzymatic Nucleic Acid
ucucaagacugaugaggccguuaggccgaaaaucauca

SEQ ID NO: 940 - RNA, 38 nt, Artificial Sequence
  Description of Artificial Sequence:  Enzymatic Nucleic Acid
gcucucaacugaugaggccguuaggccgaaagaaucau

SEQ ID NO: 941 - RNA, 38 nt, Artificial Sequence
  Description of Artificial Sequence:  Enzymatic Nucleic Acid
cugcucuccugaugaggccguuaggccgaaagagaauc

SEQ ID NO: 942 - RNA, 38 nt, Artificial Sequence
  Description of Artificial Sequence:  Enzymatic Nucleic Acid
aggaucaucugaugaggccguuaggccgaaaucacugc

SEQ ID NO: 943 - RNA, 38 nt, Artificial Sequence
  Description of Artificial Sequence:  Enzymatic Nucleic Acid
caggaucacugaugaggccguuaggccgaaaaucacug

SEQ ID NO: 944 - RNA, 38 nt, Artificial Sequence
  Description of Artificial Sequence:  Enzymatic Nucleic Acid
guucucagcugaugaggccguuaggccgaaaucauaau

SEQ ID NO: 945 - RNA, 38 nt, Artificial Sequence
  Description of Artificial Sequence:  Enzymatic Nucleic Acid
ccuugaaccugaugaggccguuaggccgaaauuuuugc

SEQ ID NO: 946 - RNA, 38 nt, Artificial Sequence
  Description of Artificial Sequence:  Enzymatic Nucleic Acid
ugaccuugcugaugaggccguuaggccgaaacuauuuu

SEQ ID NO: 947 - RNA, 38 nt, Artificial Sequence
  Description of Artificial Sequence:  Enzymatic Nucleic Acid
uugaccuucugaugaggccguuaggccgaaaacuauuu

SEQ ID NO: 948 - RNA, 38 nt, Artificial Sequence
  Description of Artificial Sequence:  Enzymatic Nucleic Acid
uagucuuucugaugaggccguuaggccgaaaccuugaa

SEQ ID NO: 949 - RNA, 38 nt, Artificial Sequence
  Description of Artificial Sequence:  Enzymatic Nucleic Acid
aaggcacucugaugaggccguuaggccgaaagucuuug

SEQ ID NO: 950 - RNA, 38 nt, Artificial Sequence
  Description of Artificial Sequence:  Enzymatic Nucleic Acid
uggaugaacugaugaggccguuaggccgaaaggcacuu

SEQ ID NO: 951 - RNA, 38 nt, Artificial Sequence
  Description of Artificial Sequence:  Enzymatic Nucleic Acid
uuggaugacugaugaggccguuaggccgaaaaggcacu

SEQ ID NO: 952 - RNA, 38 nt, Artificial Sequence
  Description of Artificial Sequence:  Enzymatic Nucleic Acid
uuuggaugcugaugaggccguuaggccgaaaaaggcac

SEQ ID NO: 953 - RNA, 38 nt, Artificial Sequence
  Description of Artificial Sequence:  Enzymatic Nucleic Acid
auuuggaucugaugaggccguuaggccgaaaaaaggca

SEQ ID NO: 954 - RNA, 38 nt, Artificial Sequence
  Description of Artificial Sequence:  Enzymatic Nucleic Acid
uccauuugcugaugaggccguuaggccgaaaugaaaag

SEQ ID NO: 955 - RNA, 38 nt, Artificial Sequence
  Description of Artificial Sequence:  Enzymatic Nucleic Acid
uaucacagcugaugaggccguuaggccgaaauuccauu

SEQ ID NO: 956 - RNA, 38 nt, Artificial Sequence
  Description of Artificial Sequence:  Enzymatic Nucleic Acid
uuaucacacugaugaggccguuaggccgaaaauuccau

SEQ ID NO: 957 - RNA, 38 nt, Artificial Sequence
  Description of Artificial Sequence:  Enzymatic Nucleic Acid
ggucccuucugaugaggccguuaggccgaaaucacaga

SEQ ID NO: 958 - RNA, 38 nt, Artificial Sequence
  Description of Artificial Sequence:  Enzymatic Nucleic Acid
auuguucccugaugaggccguuaggccgaaaggucccu

SEQ ID NO: 959 - RNA, 38 nt, Artificial Sequence
  Description of Artificial Sequence:  Enzymatic Nucleic Acid
cuuuuuuccugaugaggccguuaggccgaaauccauug

SEQ ID NO: 960 - RNA, 38 nt, Artificial Sequence
  Description of Artificial Sequence:  Enzymatic Nucleic Acid
acuuuguccugaugaggccguuaggccgaaaguuucuc

SEQ ID NO: 961 - RNA, 38 nt, Artificial Sequence
  Description of Artificial Sequence:  Enzymatic Nucleic Acid
aaagccaacugaugaggccguuaggccgaaacuuuguc

SEQ ID NO: 962 - RNA, 38 nt, Artificial Sequence
  Description of Artificial Sequence:  Enzymatic Nucleic Acid
caaagccacugaugaggccguuaggccgaaaacuuugu

SEQ ID NO: 963 - RNA, 38 nt, Artificial Sequence
  Description of Artificial Sequence:  Enzymatic Nucleic Acid
ccaaagcccugaugaggccguuaggccgaaaaacuuug

SEQ ID NO: 964 - RNA, 38 nt, Artificial Sequence
  Description of Artificial Sequence:  Enzymatic Nucleic Acid
gaguuccacugaugaggccguuaggccgaaagccaaaa

SEQ ID NO: 965 - RNA, 38 nt, Artificial Sequence
  Description of Artificial Sequence:  Enzymatic Nucleic Acid
agaguucccugaugaggccguuaggccgaaaagccaaa

SEQ ID NO: 966 - RNA, 38 nt, Artificial Sequence
  Description of Artificial Sequence:  Enzymatic Nucleic Acid
uguucaaacugaugaggccguuaggccgaaaguuccaa

SEQ ID NO: 967 - RNA, 38 nt, Artificial Sequence
  Description of Artificial Sequence:  Enzymatic Nucleic Acid
uuuguucacugaugaggccguuaggccgaaagaguucc

SEQ ID NO: 968 - RNA, 38 nt, Artificial Sequence
  Description of Artificial Sequence:  Enzymatic Nucleic Acid
auuuguuccugaugaggccguuaggccgaaaagaguuc

SEQ ID NO: 969 - RNA, 38 nt, Artificial Sequence
  Description of Artificial Sequence:  Enzymatic Nucleic Acid
ccuuuugucugaugaggccguuaggccgaaauuuguuc

SEQ ID NO: 970 - RNA, 38 nt, Artificial Sequence
  Description of Artificial Sequence:  Enzymatic Nucleic Acid
auguauaucugaugaggccguuaggccgaaauccaccc

SEQ ID NO: 971 - RNA, 38 nt, Artificial Sequence
  Description of Artificial Sequence:  Enzymatic Nucleic Acid
aauguauacugaugaggccguuaggccgaaaauccacc

SEQ ID NO: 972 - RNA, 38 nt, Artificial Sequence
  Description of Artificial Sequence:  Enzymatic Nucleic Acid
ugaauguacugaugaggccguuaggccgaaauaaucca

SEQ ID NO: 973 - RNA, 38 nt, Artificial Sequence
  Description of Artificial Sequence:  Enzymatic Nucleic Acid
uuugaaugcugaugaggccguuaggccgaaauauaauc

SEQ ID NO: 974 - RNA, 38 nt, Artificial Sequence
  Description of Artificial Sequence:  Enzymatic Nucleic Acid
uuuuuuugcugaugaggccguuaggccgaaauguauau

SEQ ID NO: 975 - RNA, 38 nt, Artificial Sequence
  Description of Artificial Sequence:  Enzymatic Nucleic Acid
auuuuuuucugaugaggccguuaggccgaaaauguaua

SEQ ID NO: 976 - RNA, 38 nt, Artificial Sequence
  Description of Artificial Sequence:  Enzymatic Nucleic Acid
uaugaauucugaugaggccguuaggccgaaauuuuuuu

SEQ ID NO: 977 - RNA, 38 nt, Artificial Sequence
  Description of Artificial Sequence:  Enzymatic Nucleic Acid
cuaugaaucugaugaggccguuaggccgaaaauuuuuu

SEQ ID NO: 978 - RNA, 38 nt, Artificial Sequence
  Description of Artificial Sequence:  Enzymatic Nucleic Acid
ucucuaugcugaugaggccguuaggccgaaauuaauuu

SEQ ID NO: 979 - RNA, 38 nt, Artificial Sequence
  Description of Artificial Sequence:  Enzymatic Nucleic Acid
aucucuaucugaugaggccguuaggccgaaaauuaauu

SEQ ID NO: 980 - RNA, 38 nt, Artificial Sequence
  Description of Artificial Sequence:  Enzymatic Nucleic Acid
aagaucuccugaugaggccguuaggccgaaaugaauua

SEQ ID NO: 981 - RNA, 38 nt, Artificial Sequence
  Description of Artificial Sequence:  Enzymatic Nucleic Acid
uggcuuaacugaugaggccguuaggccgaaaucucuau

SEQ ID NO: 982 - RNA, 38 nt, Artificial Sequence
  Description of Artificial Sequence:  Enzymatic Nucleic Acid
cuuggcuucugaugaggccguuaggccgaaagaucucu

SEQ ID NO: 983 - RNA, 38 nt, Artificial Sequence
  Description of Artificial Sequence:  Enzymatic Nucleic Acid
acuuggcucugaugaggccguuaggccgaaaagaucuc

SEQ ID NO: 984 - RNA, 38 nt, Artificial Sequence
  Description of Artificial Sequence:  Enzymatic Nucleic Acid
gaauauaucugaugaggccguuaggccgaaacuuggcu

SEQ ID NO: 985 - RNA, 38 nt, Artificial Sequence
  Description of Artificial Sequence:  Enzymatic Nucleic Acid
uaagaauacugaugaggccguuaggccgaaauuacuug

SEQ ID NO: 986 - RNA, 38 nt, Artificial Sequence
  Description of Artificial Sequence:  Enzymatic Nucleic Acid
acuaagaacugaugaggccguuaggccgaaauauuacu

SEQ ID NO: 987 - RNA, 38 nt, Artificial Sequence
  Description of Artificial Sequence:  Enzymatic Nucleic Acid
cuacuaagcugaugaggccguuaggccgaaauauauua

SEQ ID NO: 988 - RNA, 38 nt, Artificial Sequence
  Description of Artificial Sequence:  Enzymatic Nucleic Acid
ucuacuaacugaugaggccguuaggccgaaaauauauu

SEQ ID NO: 989 - RNA, 38 nt, Artificial Sequence
  Description of Artificial Sequence:  Enzymatic Nucleic Acid
uaucuacucugaugaggccguuaggccgaaagaauaua

SEQ ID NO: 990 - RNA, 38 nt, Artificial Sequence
  Description of Artificial Sequence:  Enzymatic Nucleic Acid
guaucuaccugaugaggccguuaggccgaaaagaauau

SEQ ID NO: 991 - RNA, 38 nt, Artificial Sequence
  Description of Artificial Sequence:  Enzymatic Nucleic Acid
uuuguauccugaugaggccguuaggccgaaacuaagaa

SEQ ID NO: 992 - RNA, 38 nt, Artificial Sequence
  Description of Artificial Sequence:  Enzymatic Nucleic Acid
uuguuuugcugaugaggccguuaggccgaaaucuacua

SEQ ID NO: 993 - RNA, 38 nt, Artificial Sequence
  Description of Artificial Sequence:  Enzymatic Nucleic Acid
ccaaucuucugaugaggccguuaggccgaaacuuguuu

SEQ ID NO: 994 - RNA, 38 nt, Artificial Sequence
  Description of Artificial Sequence:  Enzymatic Nucleic Acid
aagucucccugaugaggccguuaggccgaaaucuuuac

SEQ ID NO: 995 - RNA, 38 nt, Artificial Sequence
  Description of Artificial Sequence:  Enzymatic Nucleic Acid
caaguccacugaugaggccguuaggccgaaagucucca

SEQ ID NO: 996 - RNA, 38 nt, Artificial Sequence
  Description of Artificial Sequence:  Enzymatic Nucleic Acid
acaagucccugaugaggccguuaggccgaaaagucucc

SEQ ID NO: 997 - RNA, 38 nt, Artificial Sequence
  Description of Artificial Sequence:  Enzymatic Nucleic Acid
gauguuaccugaugaggccguuaggccgaaaguccaaa

SEQ ID NO: 998 - RNA, 38 nt, Artificial Sequence
  Description of Artificial Sequence:  Enzymatic Nucleic Acid
agagaugucugaugaggccguuaggccgaaacaagucc

SEQ ID NO: 999 - RNA, 38 nt, Artificial Sequence
  Description of Artificial Sequence:  Enzymatic Nucleic Acid
uuuucagacugaugaggccguuaggccgaaauguuaca

SEQ ID NO: 1000 - RNA, 38 nt, Artificial Sequence
  Description of Artificial Sequence:  Enzymatic Nucleic Acid
auuuuucacugaugaggccguuaggccgaaagauguua

SEQ ID NO: 1001 - RNA, 38 nt, Artificial Sequence
  Description of Artificial Sequence:  Enzymatic Nucleic Acid
aguucccucugaugaggccguuaggccgaaacuccuug

SEQ ID NO: 1002 - RNA, 38 nt, Artificial Sequence
  Description of Artificial Sequence:  Enzymatic Nucleic Acid
guaucgcacugaugaggccguuaggccgaaaguucccu

SEQ ID NO: 1003 - RNA, 38 nt, Artificial Sequence
  Description of Artificial Sequence:  Enzymatic Nucleic Acid
uguaucgccugaugaggccguuaggccgaaaaguuccc

SEQ ID NO: 1004 - RNA, 38 nt, Artificial Sequence
  Description of Artificial Sequence:  Enzymatic Nucleic Acid
ggcucaugcugaugaggccguuaggccgaaaucgcaaa

SEQ ID NO: 1005 - RNA, 38 nt, Artificial Sequence
  Description of Artificial Sequence:  Enzymatic Nucleic Acid
ugcgaagacugaugaggccguuaggccgaaaucuguuc

SEQ ID NO: 1006 - RNA, 38 nt, Artificial Sequence
  Description of Artificial Sequence:  Enzymatic Nucleic Acid
uugcgaagcugaugaggccguuaggccgaaaaucuguu

SEQ ID NO: 1007 - RNA, 38 nt, Artificial Sequence
  Description of Artificial Sequence:  Enzymatic Nucleic Acid
cuugcgaacugaugaggccguuaggccgaaaaaucugu

SEQ ID NO: 1008 - RNA, 38 nt, Artificial Sequence
  Description of Artificial Sequence:  Enzymatic Nucleic Acid
gucuugcgcugaugaggccguuaggccgaaagaaaucu

SEQ ID NO: 1009 - RNA, 38 nt, Artificial Sequence
  Description of Artificial Sequence:  Enzymatic Nucleic Acid
agucuugccugaugaggccguuaggccgaaaagaaauc

SEQ ID NO: 1010 - RNA, 38 nt, Artificial Sequence
  Description of Artificial Sequence:  Enzymatic Nucleic Acid
ccuuuccacugaugaggccguuaggccgaaagucuugc

SEQ ID NO: 1011 - RNA, 38 nt, Artificial Sequence
  Description of Artificial Sequence:  Enzymatic Nucleic Acid
aaagcguacugaugaggccguuaggccgaaagguccac

SEQ ID NO: 1012 - RNA, 38 nt, Artificial Sequence
  Description of Artificial Sequence:  Enzymatic Nucleic Acid
ccaaagcgcugaugaggccguuaggccgaaagaggucc

SEQ ID NO: 1013 - RNA, 38 nt, Artificial Sequence
  Description of Artificial Sequence:  Enzymatic Nucleic Acid
uagccccacugaugaggccguuaggccgaaagcguaga

SEQ ID NO: 1014 - RNA, 38 nt, Artificial Sequence
  Description of Artificial Sequence:  Enzymatic Nucleic Acid
uuagcccccugaugaggccguuaggccgaaaagcguag

SEQ ID NO: 1015 - RNA, 38 nt, Artificial Sequence
  Description of Artificial Sequence:  Enzymatic Nucleic Acid
gcaagaaucugaugaggccguuaggccgaaagccccaa

SEQ ID NO: 1016 - RNA, 38 nt, Artificial Sequence
  Description of Artificial Sequence:  Enzymatic Nucleic Acid
ucagcaagcugaugaggccguuaggccgaaauuagccc

SEQ ID NO: 1017 - RNA, 38 nt, Artificial Sequence
  Description of Artificial Sequence:  Enzymatic Nucleic Acid
uucagcaacugaugaggccguuaggccgaaaauuagcc

SEQ ID NO: 1018 - RNA, 38 nt, Artificial Sequence
  Description of Artificial Sequence:  Enzymatic Nucleic Acid
aguucagccugaugaggccguuaggccgaaagaauuag

SEQ ID NO: 1019 - RNA, 38 nt, Artificial Sequence
  Description of Artificial Sequence:  Enzymatic Nucleic Acid
acaugaagcugaugaggccguuaggccgaaaguucagc

SEQ ID NO: 1020 - RNA, 38 nt, Artificial Sequence
  Description of Artificial Sequence:  Enzymatic Nucleic Acid
uacaugaacugaugaggccguuaggccgaaaaguucag

SEQ ID NO: 1021 - RNA, 38 nt, Artificial Sequence
  Description of Artificial Sequence:  Enzymatic Nucleic Acid
cauacaugcugaugaggccguuaggccgaaagaaguuc

SEQ ID NO: 1022 - RNA, 38 nt, Artificial Sequence
  Description of Artificial Sequence:  Enzymatic Nucleic Acid
acauacaucugaugaggccguuaggccgaaaagaaguu

SEQ ID NO: 1023 - RNA, 38 nt, Artificial Sequence
  Description of Artificial Sequence:  Enzymatic Nucleic Acid
gugucacacugaugaggccguuaggccgaaacaugaag

SEQ ID NO: 1024 - RNA, 38 nt, Artificial Sequence
  Description of Artificial Sequence:  Enzymatic Nucleic Acid
uguuucaacugaugaggccguuaggccgaaagcagugu

SEQ ID NO: 1025 - RNA, 38 nt, Artificial Sequence
  Description of Artificial Sequence:  Enzymatic Nucleic Acid
auguuucacugaugaggccguuaggccgaaaagcagug

SEQ ID NO: 1026 - RNA, 38 nt, Artificial Sequence
  Description of Artificial Sequence:  Enzymatic Nucleic Acid
gauguuuccugaugaggccguuaggccgaaaaagcagu

SEQ ID NO: 1027 - RNA, 38 nt, Artificial Sequence
  Description of Artificial Sequence:  Enzymatic Nucleic Acid
aaaacuuucugaugaggccguuaggccgaaauguuuca

SEQ ID NO: 1028 - RNA, 38 nt, Artificial Sequence
  Description of Artificial Sequence:  Enzymatic Nucleic Acid
cugugaaacugaugaggccguuaggccgaaacuuugau

SEQ ID NO: 1029 - RNA, 38 nt, Artificial Sequence
  Description of Artificial Sequence:  Enzymatic Nucleic Acid
ucugugaacugaugaggccguuaggccgaaaacuuuga

SEQ ID NO: 1030 - RNA, 38 nt, Artificial Sequence
  Description of Artificial Sequence:  Enzymatic Nucleic Acid
gucugugacugaugaggccguuaggccgaaaaacuuug

SEQ ID NO: 1031 - RNA, 38 nt, Artificial Sequence
  Description of Artificial Sequence:  Enzymatic Nucleic Acid
ggucugugcugaugaggccguuaggccgaaaaaacuuu

SEQ ID NO: 1032 - RNA, 38 nt, Artificial Sequence
  Description of Artificial Sequence:  Enzymatic Nucleic Acid
aggucugucugaugaggccguuaggccgaaaaaaacuu

SEQ ID NO: 1033 - RNA, 38 nt, Artificial Sequence
  Description of Artificial Sequence:  Enzymatic Nucleic Acid
ccaucccgcugaugaggccguuaggccgaaaggucugu

SEQ ID NO: 1034 - RNA, 38 nt, Artificial Sequence
  Description of Artificial Sequence:  Enzymatic Nucleic Acid
ucugagaucugaugaggccguuaggccgaaaugccauc

SEQ ID NO: 1035 - RNA, 38 nt, Artificial Sequence
  Description of Artificial Sequence:  Enzymatic Nucleic Acid
auaucugacugaugaggccguuaggccgaaaugaugcc

SEQ ID NO: 1036 - RNA, 38 nt, Artificial Sequence
  Description of Artificial Sequence:  Enzymatic Nucleic Acid
auauaucucugaugaggccguuaggccgaaagaugaug

SEQ ID NO: 1037 - RNA, 38 nt, Artificial Sequence
  Description of Artificial Sequence:  Enzymatic Nucleic Acid
aucaaauacugaugaggccguuaggccgaaaucugaga

SEQ ID NO: 1038 - RNA, 38 nt, Artificial Sequence
  Description of Artificial Sequence:  Enzymatic Nucleic Acid
uuaucaaacugaugaggccguuaggccgaaauaucuga

SEQ ID NO: 1039 - RNA, 38 nt, Artificial Sequence
  Description of Artificial Sequence:  Enzymatic Nucleic Acid
uuuuaucacugaugaggccguuaggccgaaauauaucu

SEQ ID NO: 1040 - RNA, 38 nt, Artificial Sequence
  Description of Artificial Sequence:  Enzymatic Nucleic Acid
uuuuuauccugaugaggccguuaggccgaaaauauauc

SEQ ID NO: 1041 - RNA, 38 nt, Artificial Sequence
  Description of Artificial Sequence:  Enzymatic Nucleic Acid
uucuuuuucugaugaggccguuaggccgaaaucaaaua

SEQ ID NO: 1042 - RNA, 38 nt, Artificial Sequence
  Description of Artificial Sequence:  Enzymatic Nucleic Acid
cuguagaacugaugaggccguuaggccgaaaguuuuuu

SEQ ID NO: 1043 - RNA, 38 nt, Artificial Sequence
  Description of Artificial Sequence:  Enzymatic Nucleic Acid
uucuguagcugaugaggccguuaggccgaaagaguuuu

SEQ ID NO: 1044 - RNA, 38 nt, Artificial Sequence
  Description of Artificial Sequence:  Enzymatic Nucleic Acid
uuucuguacugaugaggccguuaggccgaaaagaguuu

SEQ ID NO: 1045 - RNA, 38 nt, Artificial Sequence
  Description of Artificial Sequence:  Enzymatic Nucleic Acid
aauuucugcugaugaggccguuaggccgaaagaagagu

SEQ ID NO: 1046 - RNA, 38 nt, Artificial Sequence
  Description of Artificial Sequence:  Enzymatic Nucleic Acid
uugagagucugaugaggccguuaggccgaaauuucugu

SEQ ID NO: 1047 - RNA, 38 nt, Artificial Sequence
  Description of Artificial Sequence:  Enzymatic Nucleic Acid
uuugagagcugaugaggccguuaggccgaaaauuucug

SEQ ID NO: 1048 - RNA, 38 nt, Artificial Sequence
  Description of Artificial Sequence:  Enzymatic Nucleic Acid
uucuuugacugaugaggccguuaggccgaaaguaauuu

SEQ ID NO: 1049 - RNA, 38 nt, Artificial Sequence
  Description of Artificial Sequence:  Enzymatic Nucleic Acid
guuucuuucugaugaggccguuaggccgaaagaguaau

SEQ ID NO: 1050 - RNA, 38 nt, Artificial Sequence
  Description of Artificial Sequence:  Enzymatic Nucleic Acid
guuagguccugaugaggccguuaggccgaaauccucag

SEQ ID NO: 1051 - RNA, 38 nt, Artificial Sequence
  Description of Artificial Sequence:  Enzymatic Nucleic Acid
agaugugucugaugaggccguuaggccgaaaggucgau

SEQ ID NO: 1052 - RNA, 38 nt, Artificial Sequence
  Description of Artificial Sequence:  Enzymatic Nucleic Acid
guauuucacugaugaggccguuaggccgaaauguguua

SEQ ID NO: 1053 - RNA, 38 nt, Artificial Sequence
  Description of Artificial Sequence:  Enzymatic Nucleic Acid
guccuuagcugaugaggccguuaggccgaaauuucaga

SEQ ID NO: 1054 - RNA, 38 nt, Artificial Sequence
  Description of Artificial Sequence:  Enzymatic Nucleic Acid
aagguccucugaugaggccguuaggccgaaaguauuuc

SEQ ID NO: 1055 - RNA, 38 nt, Artificial Sequence
  Description of Artificial Sequence:  Enzymatic Nucleic Acid
acacaguccugaugaggccguuaggccgaaagguccuu

SEQ ID NO: 1056 - RNA, 38 nt, Artificial Sequence
  Description of Artificial Sequence:  Enzymatic Nucleic Acid
agggcucucugaugaggccguuaggccgaaacaugugu

SEQ ID NO: 1057 - RNA, 38 nt, Artificial Sequence
  Description of Artificial Sequence:  Enzymatic Nucleic Acid
aagggcuccugaugaggccguuaggccgaaaacaugug

SEQ ID NO: 1058 - RNA, 38 nt, Artificial Sequence
  Description of Artificial Sequence:  Enzymatic Nucleic Acid
uuuuucagcugaugaggccguuaggccgaaagggcucu

SEQ ID NO: 1059 - RNA, 38 nt, Artificial Sequence
  Description of Artificial Sequence:  Enzymatic Nucleic Acid
cuuuuucacugaugaggccguuaggccgaaaagggcuc

SEQ ID NO: 1060 - RNA, 38 nt, Artificial Sequence
  Description of Artificial Sequence:  Enzymatic Nucleic Acid
aagcaggacugaugaggccguuaggccgaaacuuuuuc

SEQ ID NO: 1061 - RNA, 38 nt, Artificial Sequence
  Description of Artificial Sequence:  Enzymatic Nucleic Acid
agaagcagcugaugaggccguuaggccgaaauacuuuu

SEQ ID NO: 1062 - RNA, 38 nt, Artificial Sequence
  Description of Artificial Sequence:  Enzymatic Nucleic Acid
cauaucagcugaugaggccguuaggccgaaagcaggau

SEQ ID NO: 1063 - RNA, 38 nt, Artificial Sequence
  Description of Artificial Sequence:  Enzymatic Nucleic Acid
gcauaucacugaugaggccguuaggccgaaaagcagga

SEQ ID NO: 1064 - RNA, 38 nt, Artificial Sequence
  Description of Artificial Sequence:  Enzymatic Nucleic Acid
aaacugcacugaugaggccguuaggccgaaaucagaag

SEQ ID NO: 1065 - RNA, 38 nt, Artificial Sequence
  Description of Artificial Sequence:  Enzymatic Nucleic Acid
uuaaggaacugaugaggccguuaggccgaaacugcaua

SEQ ID NO: 1066 - RNA, 38 nt, Artificial Sequence
  Description of Artificial Sequence:  Enzymatic Nucleic Acid
uuuaaggacugaugaggccguuaggccgaaaacugcau

SEQ ID NO: 1067 - RNA, 38 nt, Artificial Sequence
  Description of Artificial Sequence:  Enzymatic Nucleic Acid
auuuaaggcugaugaggccguuaggccgaaaaacugca

SEQ ID NO: 1068 - RNA, 38 nt, Artificial Sequence
  Description of Artificial Sequence:  Enzymatic Nucleic Acid
aauuuaagcugaugaggccguuaggccgaaaaaacugc

SEQ ID NO: 1069 - RNA, 38 nt, Artificial Sequence
  Description of Artificial Sequence:  Enzymatic Nucleic Acid
gauaauuucugaugaggccguuaggccgaaaggaaaac

SEQ ID NO: 1070 - RNA, 38 nt, Artificial Sequence
  Description of Artificial Sequence:  Enzymatic Nucleic Acid
agauaauucugaugaggccguuaggccgaaaaggaaaa

SEQ ID NO: 1071 - RNA, 38 nt, Artificial Sequence
  Description of Artificial Sequence:  Enzymatic Nucleic Acid
uuuuagaucugaugaggccguuaggccgaaauuuaagg

SEQ ID NO: 1072 - RNA, 38 nt, Artificial Sequence
  Description of Artificial Sequence:  Enzymatic Nucleic Acid
auuuuagacugaugaggccguuaggccgaaaauuuaag

SEQ ID NO: 1073 - RNA, 38 nt, Artificial Sequence
  Description of Artificial Sequence:  Enzymatic Nucleic Acid
agauuuuacugaugaggccguuaggccgaaauaauuua

SEQ ID NO: 1074 - RNA, 38 nt, Artificial Sequence
  Description of Artificial Sequence:  Enzymatic Nucleic Acid
gcagauuucugaugaggccguuaggccgaaagauaauu

SEQ ID NO: 1075 - RNA, 38 nt, Artificial Sequence
  Description of Artificial Sequence:  Enzymatic Nucleic Acid
cccuagcacugaugaggccguuaggccgaaauuuuaga

SEQ ID NO: 1076 - RNA, 38 nt, Artificial Sequence
  Description of Artificial Sequence:  Enzymatic Nucleic Acid
auauuccccugaugaggccguuaggccgaaagcagauu

SEQ ID NO: 1077 - RNA, 38 nt, Artificial Sequence
  Description of Artificial Sequence:  Enzymatic Nucleic Acid
ucuauugacugaugaggccguuaggccgaaauucccua

SEQ ID NO: 1078 - RNA, 38 nt, Artificial Sequence
  Description of Artificial Sequence:  Enzymatic Nucleic Acid
uaucuauucugaugaggccguuaggccgaaauauuccc

SEQ ID NO: 1079 - RNA, 38 nt, Artificial Sequence
  Description of Artificial Sequence:  Enzymatic Nucleic Acid
uaaauauccugaugaggccguuaggccgaaauugauau

SEQ ID NO: 1080 - RNA, 38 nt, Artificial Sequence
  Description of Artificial Sequence:  Enzymatic Nucleic Acid
aagguaaacugaugaggccguuaggccgaaaucuauug

SEQ ID NO: 1081 - RNA, 38 nt, Artificial Sequence
  Description of Artificial Sequence:  Enzymatic Nucleic Acid
aaaagguacugaugaggccguuaggccgaaauaucuau

SEQ ID NO: 1082 - RNA, 38 nt, Artificial Sequence
  Description of Artificial Sequence:  Enzymatic Nucleic Acid
uaaaaggucugaugaggccguuaggccgaaaauaucua

SEQ ID NO: 1083 - RNA, 38 nt, Artificial Sequence
  Description of Artificial Sequence:  Enzymatic Nucleic Acid
auaaaaggcugaugaggccguuaggccgaaaaauaucu

SEQ ID NO: 1084 - RNA, 38 nt, Artificial Sequence
  Description of Artificial Sequence:  Enzymatic Nucleic Acid
uaaaauaacugaugaggccguuaggccgaaagguaaau

SEQ ID NO: 1085 - RNA, 38 nt, Artificial Sequence
  Description of Artificial Sequence:  Enzymatic Nucleic Acid
uuaaaauacugaugaggccguuaggccgaaaagguaaa

SEQ ID NO: 1086 - RNA, 38 nt, Artificial Sequence
  Description of Artificial Sequence:  Enzymatic Nucleic Acid
auuaaaaucugaugaggccguuaggccgaaaaagguaa

SEQ ID NO: 1087 - RNA, 38 nt, Artificial Sequence
  Description of Artificial Sequence:  Enzymatic Nucleic Acid
cauuaaaacugaugaggccguuaggccgaaaaaaggua

SEQ ID NO: 1088 - RNA, 38 nt, Artificial Sequence
  Description of Artificial Sequence:  Enzymatic Nucleic Acid
aacauuaacugaugaggccguuaggccgaaauaaaagg

SEQ ID NO: 1089 - RNA, 38 nt, Artificial Sequence
  Description of Artificial Sequence:  Enzymatic Nucleic Acid
aaacauuacugaugaggccguuaggccgaaaauaaaag

SEQ ID NO: 1090 - RNA, 38 nt, Artificial Sequence
  Description of Artificial Sequence:  Enzymatic Nucleic Acid
gaaacauucugaugaggccguuaggccgaaaaauaaaa

SEQ ID NO: 1091 - RNA, 38 nt, Artificial Sequence
  Description of Artificial Sequence:  Enzymatic Nucleic Acid
ggaaacaucugaugaggccguuaggccgaaaaaauaaa

SEQ ID NO: 1092 - RNA, 38 nt, Artificial Sequence
  Description of Artificial Sequence:  Enzymatic Nucleic Acid
uuaaaggacugaugaggccguuaggccgaaacauuaaa

SEQ ID NO: 1093 - RNA, 38 nt, Artificial Sequence
  Description of Artificial Sequence:  Enzymatic Nucleic Acid
auuaaaggcugaugaggccguuaggccgaaaacauuaa

SEQ ID NO: 1094 - RNA, 38 nt, Artificial Sequence
  Description of Artificial Sequence:  Enzymatic Nucleic Acid
aauuaaagcugaugaggccguuaggccgaaaaacauua

SEQ ID NO: 1095 - RNA, 38 nt, Artificial Sequence
  Description of Artificial Sequence:  Enzymatic Nucleic Acid
aaaaauuacugaugaggccguuaggccgaaaggaaaca

SEQ ID NO: 1096 - RNA, 38 nt, Artificial Sequence
  Description of Artificial Sequence:  Enzymatic Nucleic Acid
aaaaaauucugaugaggccguuaggccgaaaaggaaac

SEQ ID NO: 1097 - RNA, 38 nt, Artificial Sequence
  Description of Artificial Sequence:  Enzymatic Nucleic Acid
uaaaaaaucugaugaggccguuaggccgaaaaaggaaa

SEQ ID NO: 1098 - RNA, 38 nt, Artificial Sequence
  Description of Artificial Sequence:  Enzymatic Nucleic Acid
uaguaaaacugaugaggccguuaggccgaaauuaaagg

SEQ ID NO: 1099 - RNA, 38 nt, Artificial Sequence
  Description of Artificial Sequence:  Enzymatic Nucleic Acid
auaguaaacugaugaggccguuaggccgaaaauuaaag

SEQ ID NO: 1100 - RNA, 38 nt, Artificial Sequence
  Description of Artificial Sequence:  Enzymatic Nucleic Acid
aauaguaacugaugaggccguuaggccgaaaaauuaaa

SEQ ID NO: 1101 - RNA, 38 nt, Artificial Sequence
  Description of Artificial Sequence:  Enzymatic Nucleic Acid
aaauaguacugaugaggccguuaggccgaaaaaauuaa

SEQ ID NO: 1102 - RNA, 38 nt, Artificial Sequence
  Description of Artificial Sequence:  Enzymatic Nucleic Acid
aaaauagucugaugaggccguuaggccgaaaaaaauua

SEQ ID NO: 1103 - RNA, 38 nt, Artificial Sequence
  Description of Artificial Sequence:  Enzymatic Nucleic Acid
aaaaauagcugaugaggccguuaggccgaaaaaaaauu

SEQ ID NO: 1104 - RNA, 38 nt, Artificial Sequence
  Description of Artificial Sequence:  Enzymatic Nucleic Acid
aguaaaaacugaugaggccguuaggccgaaaguaaaaa

SEQ ID NO: 1105 - RNA, 38 nt, Artificial Sequence
  Description of Artificial Sequence:  Enzymatic Nucleic Acid
uuaguaaacugaugaggccguuaggccgaaauaguaaa

SEQ ID NO: 1106 - RNA, 38 nt, Artificial Sequence
  Description of Artificial Sequence:  Enzymatic Nucleic Acid
auuaguaacugaugaggccguuaggccgaaaauaguaa

SEQ ID NO: 1107 - RNA, 38 nt, Artificial Sequence
  Description of Artificial Sequence:  Enzymatic Nucleic Acid
gauuaguacugaugaggccguuaggccgaaaaauagua

SEQ ID NO: 1108 - RNA, 38 nt, Artificial Sequence
  Description of Artificial Sequence:  Enzymatic Nucleic Acid
agauuagucugaugaggccguuaggccgaaaaaauagu

SEQ ID NO: 1109 - RNA, 38 nt, Artificial Sequence
  Description of Artificial Sequence:  Enzymatic Nucleic Acid
aagauuagcugaugaggccguuaggccgaaaaaaauag

SEQ ID NO: 1110 - RNA, 38 nt, Artificial Sequence
  Description of Artificial Sequence:  Enzymatic Nucleic Acid
agaaagaucugaugaggccguuaggccgaaaguaaaaa

SEQ ID NO: 1111 - RNA, 38 nt, Artificial Sequence
  Description of Artificial Sequence:  Enzymatic Nucleic Acid
ugcagaaacugaugaggccguuaggccgaaauuaguaa

SEQ ID NO: 1112 - RNA, 38 nt, Artificial Sequence
  Description of Artificial Sequence:  Enzymatic Nucleic Acid
ucugcagacugaugaggccguuaggccgaaagauuagu

SEQ ID NO: 1113 - RNA, 38 nt, Artificial Sequence
  Description of Artificial Sequence:  Enzymatic Nucleic Acid
uucugcagcugaugaggccguuaggccgaaaagauuag

SEQ ID NO: 1114 - RNA, 38 nt, Artificial Sequence
  Description of Artificial Sequence:  Enzymatic Nucleic Acid
uuucugcacugaugaggccguuaggccgaaaaagauua

SEQ ID NO: 1115 - RNA, 38 nt, Artificial Sequence
  Description of Artificial Sequence:  Enzymatic Nucleic Acid
aagaagaacugaugaggccguuaggccgaaaccuuucu

SEQ ID NO: 1116 - RNA, 38 nt, Artificial Sequence
  Description of Artificial Sequence:  Enzymatic Nucleic Acid
aaagaagacugaugaggccguuaggccgaaaaccuuuc

SEQ ID NO: 1117 - RNA, 38 nt, Artificial Sequence
  Description of Artificial Sequence:  Enzymatic Nucleic Acid
aaaagaagcugaugaggccguuaggccgaaaaaccuuu

SEQ ID NO: 1118 - RNA, 38 nt, Artificial Sequence
  Description of Artificial Sequence:  Enzymatic Nucleic Acid
aaaaagaacugaugaggccguuaggccgaaaaaaccuu

SEQ ID NO: 1119 - RNA, 38 nt, Artificial Sequence
  Description of Artificial Sequence:  Enzymatic Nucleic Acid
gcaaaaagcugaugaggccguuaggccgaaagaaaacc

SEQ ID NO: 1120 - RNA, 38 nt, Artificial Sequence
  Description of Artificial Sequence:  Enzymatic Nucleic Acid
agcaaaaacugaugaggccguuaggccgaaaagaaaac

SEQ ID NO: 1121 - RNA, 38 nt, Artificial Sequence
  Description of Artificial Sequence:  Enzymatic Nucleic Acid
gaagcaaacugaugaggccguuaggccgaaagaagaaa

SEQ ID NO: 1122 - RNA, 38 nt, Artificial Sequence
  Description of Artificial Sequence:  Enzymatic Nucleic Acid
ugaagcaacugaugaggccguuaggccgaaaagaagaa

SEQ ID NO: 1123 - RNA, 38 nt, Artificial Sequence
  Description of Artificial Sequence:  Enzymatic Nucleic Acid
uugaagcacugaugaggccguuaggccgaaaaagaaga

SEQ ID NO: 1124 - RNA, 38 nt, Artificial Sequence
  Description of Artificial Sequence:  Enzymatic Nucleic Acid
uuugaagccugaugaggccguuaggccgaaaaaagaag

SEQ ID NO: 1125 - RNA, 38 nt, Artificial Sequence
  Description of Artificial Sequence:  Enzymatic Nucleic Acid
uguuuuugcugaugaggccguuaggccgaaagcaaaaa

SEQ ID NO: 1126 - RNA, 38 nt, Artificial Sequence
  Description of Artificial Sequence:  Enzymatic Nucleic Acid
auguuuuucugaugaggccguuaggccgaaaagcaaaa

SEQ ID NO: 1127 - RNA, 38 nt, Artificial Sequence
  Description of Artificial Sequence:  Enzymatic Nucleic Acid
aauguaagcugaugaggccguuaggccgaaauguuuuu

SEQ ID NO: 1128 - RNA, 38 nt, Artificial Sequence
  Description of Artificial Sequence:  Enzymatic Nucleic Acid
aaauguaacugaugaggccguuaggccgaaaauguuuu

SEQ ID NO: 1129 - RNA, 38 nt, Artificial Sequence
  Description of Artificial Sequence:  Enzymatic Nucleic Acid
uaaaaugucugaugaggccguuaggccgaaagaauguu

SEQ ID NO: 1130 - RNA, 38 nt, Artificial Sequence
  Description of Artificial Sequence:  Enzymatic Nucleic Acid
guaaaaugcugaugaggccguuaggccgaaaagaaugu

SEQ ID NO: 1131 - RNA, 38 nt, Artificial Sequence
  Description of Artificial Sequence:  Enzymatic Nucleic Acid
aaaaguaacugaugaggccguuaggccgaaauguaaga

SEQ ID NO: 1132 - RNA, 38 nt, Artificial Sequence
  Description of Artificial Sequence:  Enzymatic Nucleic Acid
aaaaaguacugaugaggccguuaggccgaaaauguaag

SEQ ID NO: 1133 - RNA, 38 nt, Artificial Sequence
  Description of Artificial Sequence:  Enzymatic Nucleic Acid
gaaaaagucugaugaggccguuaggccgaaaaauguaa

SEQ ID NO: 1134 - RNA, 38 nt, Artificial Sequence
  Description of Artificial Sequence:  Enzymatic Nucleic Acid
ggaaaaagcugaugaggccguuaggccgaaaaaaugua

SEQ ID NO: 1135 - RNA, 38 nt, Artificial Sequence
  Description of Artificial Sequence:  Enzymatic Nucleic Acid
ccaggaaacugaugaggccguuaggccgaaaguaaaau

SEQ ID NO: 1136 - RNA, 38 nt, Artificial Sequence
  Description of Artificial Sequence:  Enzymatic Nucleic Acid
gccaggaacugaugaggccguuaggccgaaaaguaaaa

SEQ ID NO: 1137 - RNA, 38 nt, Artificial Sequence
  Description of Artificial Sequence:  Enzymatic Nucleic Acid
agccaggacugaugaggccguuaggccgaaaaaguaaa

SEQ ID NO: 1138 - RNA, 38 nt, Artificial Sequence
  Description of Artificial Sequence:  Enzymatic Nucleic Acid
gagccaggcugaugaggccguuaggccgaaaaaaguaa

SEQ ID NO: 1139 - RNA, 38 nt, Artificial Sequence
  Description of Artificial Sequence:  Enzymatic Nucleic Acid
ugagccagcugaugaggccguuaggccgaaaaaaagua

SEQ ID NO: 1140 - RNA, 38 nt, Artificial Sequence
  Description of Artificial Sequence:  Enzymatic Nucleic Acid
aaagagaucugaugaggccguuaggccgaaagccagga

SEQ ID NO: 1141 - RNA, 38 nt, Artificial Sequence
  Description of Artificial Sequence:  Enzymatic Nucleic Acid
aauaaagacugaugaggccguuaggccgaaaugagcca

SEQ ID NO: 1142 - RNA, 38 nt, Artificial Sequence
  Description of Artificial Sequence:  Enzymatic Nucleic Acid
agaauaaacugaugaggccguuaggccgaaagaugagc

SEQ ID NO: 1143 - RNA, 38 nt, Artificial Sequence
  Description of Artificial Sequence:  Enzymatic Nucleic Acid
aaagaauacugaugaggccguuaggccgaaagagauga

SEQ ID NO: 1144 - RNA, 38 nt, Artificial Sequence
  Description of Artificial Sequence:  Enzymatic Nucleic Acid
aaaagaaucugaugaggccguuaggccgaaaagagaug

SEQ ID NO: 1145 - RNA, 38 nt, Artificial Sequence
  Description of Artificial Sequence:  Enzymatic Nucleic Acid
aaaaagaacugaugaggccguuaggccgaaaaagagau

SEQ ID NO: 1146 - RNA, 38 nt, Artificial Sequence
  Description of Artificial Sequence:  Enzymatic Nucleic Acid
aaaaaaagcugaugaggccguuaggccgaaauaaagag

SEQ ID NO: 1147 - RNA, 38 nt, Artificial Sequence
  Description of Artificial Sequence:  Enzymatic Nucleic Acid
aaaaaaaacugaugaggccguuaggccgaaaauaaaga

SEQ ID NO: 1148 - RNA, 38 nt, Artificial Sequence
  Description of Artificial Sequence:  Enzymatic Nucleic Acid
aaaaaaaacugaugaggccguuaggccgaaagaauaaa

SEQ ID NO: 1149 - RNA, 38 nt, Artificial Sequence
  Description of Artificial Sequence:  Enzymatic Nucleic Acid
aaaaaaaacugaugaggccguuaggccgaaaagaauaa

SEQ ID NO: 1150 - RNA, 38 nt, Artificial Sequence
  Description of Artificial Sequence:  Enzymatic Nucleic Acid
aaaaaaaacugaugaggccguuaggccgaaaaagaaua

SEQ ID NO: 1151 - RNA, 38 nt, Artificial Sequence
  Description of Artificial Sequence:  Enzymatic Nucleic Acid
aaaaaaaacugaugaggccguuaggccgaaaaaagaau

SEQ ID NO: 1152 - RNA, 38 nt, Artificial Sequence
  Description of Artificial Sequence:  Enzymatic Nucleic Acid
aaaaaaaacugaugaggccguuaggccgaaaaaaagaa

SEQ ID NO: 1153 - RNA, 38 nt, Artificial Sequence
  Description of Artificial Sequence:  Enzymatic Nucleic Acid
uaaaaaaacugaugaggccguuaggccgaaaaaaaaga

SEQ ID NO: 1154 - RNA, 38 nt, Artificial Sequence
  Description of Artificial Sequence:  Enzymatic Nucleic Acid
uuaaaaaacugaugaggccguuaggccgaaaaaaaaag

SEQ ID NO: 1155 - RNA, 38 nt, Artificial Sequence
  Description of Artificial Sequence:  Enzymatic Nucleic Acid
uuuaaaaacugaugaggccguuaggccgaaaaaaaaaa

SEQ ID NO: 1156 - RNA, 38 nt, Artificial Sequence
  Description of Artificial Sequence:  Enzymatic Nucleic Acid
cuuuaaaacugaugaggccguuaggccgaaaaaaaaaa

SEQ ID NO: 1157 - RNA, 38 nt, Artificial Sequence
  Description of Artificial Sequence:  Enzymatic Nucleic Acid
ucuuuaaacugaugaggccguuaggccgaaaaaaaaaa

SEQ ID NO: 1158 - RNA, 38 nt, Artificial Sequence
  Description of Artificial Sequence:  Enzymatic Nucleic Acid
gucuuuaacugaugaggccguuaggccgaaaaaaaaaa

SEQ ID NO: 1159 - RNA, 38 nt, Artificial Sequence
  Description of Artificial Sequence:  Enzymatic Nucleic Acid
ugucuuuacugaugaggccguuaggccgaaaaaaaaaa

SEQ ID NO: 1160 - RNA, 38 nt, Artificial Sequence
  Description of Artificial Sequence:  Enzymatic Nucleic Acid
cugucuuucugaugaggccguuaggccgaaaaaaaaaa

SEQ ID NO: 1161 - RNA, 38 nt, Artificial Sequence
  Description of Artificial Sequence:  Enzymatic Nucleic Acid
ucugucuucugaugaggccguuaggccgaaaaaaaaaa

SEQ ID NO: 1162 - RNA, 38 nt, Artificial Sequence
  Description of Artificial Sequence:  Enzymatic Nucleic Acid
cagagcgacugaugaggccguuaggccgaaacucuguc

SEQ ID NO: 1163 - RNA, 38 nt, Artificial Sequence
  Description of Artificial Sequence:  Enzymatic Nucleic Acid
aacagagccugaugaggccguuaggccgaaagacucug

SEQ ID NO: 1164 - RNA, 38 nt, Artificial Sequence
  Description of Artificial Sequence:  Enzymatic Nucleic Acid
gggcaacacugaugaggccguuaggccgaaagcgagac

SEQ ID NO: 1165 - RNA, 38 nt, Artificial Sequence
  Description of Artificial Sequence:  Enzymatic Nucleic Acid
gccugggccugaugaggccguuaggccgaaacagagcg

SEQ ID NO: 1166 - RNA, 38 nt, Artificial Sequence
  Description of Artificial Sequence:  Enzymatic Nucleic Acid
ugagccaacugaugaggccguuaggccgaaacuguguc

SEQ ID NO: 1167 - RNA, 38 nt, Artificial Sequence
  Description of Artificial Sequence:  Enzymatic Nucleic Acid
agugagcccugaugaggccguuaggccgaaagacugug

SEQ ID NO: 1168 - RNA, 38 nt, Artificial Sequence
  Description of Artificial Sequence:  Enzymatic Nucleic Acid
guugcagucugaugaggccguuaggccgaaagccaaga

SEQ ID NO: 1169 - RNA, 38 nt, Artificial Sequence
  Description of Artificial Sequence:  Enzymatic Nucleic Acid
agaggcagcugaugaggccguuaggccgaaaguugcag

SEQ ID NO: 1170 - RNA, 38 nt, Artificial Sequence
  Description of Artificial Sequence:  Enzymatic Nucleic Acid
aagaggcacugaugaggccguuaggccgaaaaguugca

SEQ ID NO: 1171 - RNA, 38 nt, Artificial Sequence
  Description of Artificial Sequence:  Enzymatic Nucleic Acid
gaacccaacugaugaggccguuaggccgaaaggcagaa

SEQ ID NO: 1172 - RNA, 38 nt, Artificial Sequence
  Description of Artificial Sequence:  Enzymatic Nucleic Acid
uugaaccccugaugaggccguuaggccgaaagaggcag

SEQ ID NO: 1173 - RNA, 38 nt, Artificial Sequence
  Description of Artificial Sequence:  Enzymatic Nucleic Acid
aucacuugcugaugaggccguuaggccgaaacccaaga

SEQ ID NO: 1174 - RNA, 38 nt, Artificial Sequence
  Description of Artificial Sequence:  Enzymatic Nucleic Acid
aaucacuucugaugaggccguuaggccgaaaacccaag

SEQ ID NO: 1175 - RNA, 38 nt, Artificial Sequence
  Description of Artificial Sequence:  Enzymatic Nucleic Acid
ggcaggagcugaugaggccguuaggccgaaaucacuug

SEQ ID NO: 1176 - RNA, 38 nt, Artificial Sequence
  Description of Artificial Sequence:  Enzymatic Nucleic Acid
aggcaggacugaugaggccguuaggccgaaaaucacuu

SEQ ID NO: 1177 - RNA, 38 nt, Artificial Sequence
  Description of Artificial Sequence:  Enzymatic Nucleic Acid
ugaggcagcugaugaggccguuaggccgaaagaaucac

SEQ ID NO: 1178 - RNA, 38 nt, Artificial Sequence
  Description of Artificial Sequence:  Enzymatic Nucleic Acid
aggaggcucugaugaggccguuaggccgaaaggcagga

SEQ ID NO: 1179 - RNA, 38 nt, Artificial Sequence
  Description of Artificial Sequence:  Enzymatic Nucleic Acid
cuacucagcugaugaggccguuaggccgaaaggcugag

SEQ ID NO: 1180 - RNA, 38 nt, Artificial Sequence
  Description of Artificial Sequence:  Enzymatic Nucleic Acid
aauccagccugaugaggccguuaggccgaaacucagga

SEQ ID NO: 1181 - RNA, 38 nt, Artificial Sequence
  Description of Artificial Sequence:  Enzymatic Nucleic Acid
augccugucugaugaggccguuaggccgaaauccagcu

SEQ ID NO: 1182 - RNA, 38 nt, Artificial Sequence
  Description of Artificial Sequence:  Enzymatic Nucleic Acid
caugccugcugaugaggccguuaggccgaaaauccagc

SEQ ID NO: 1183 - RNA, 38 nt, Artificial Sequence
  Description of Artificial Sequence:  Enzymatic Nucleic Acid
acaaaaaucugaugaggccguuaggccgaaaguugggu

SEQ ID NO: 1184 - RNA, 38 nt, Artificial Sequence
  Description of Artificial Sequence:  Enzymatic Nucleic Acid
aacacaaacugaugaggccguuaggccgaaauuaguug

SEQ ID NO: 1185 - RNA, 38 nt, Artificial Sequence
  Description of Artificial Sequence:  Enzymatic Nucleic Acid
aaacacaacugaugaggccguuaggccgaaaauuaguu

SEQ ID NO: 1186 - RNA, 38 nt, Artificial Sequence
  Description of Artificial Sequence:  Enzymatic Nucleic Acid
aaaacacacugaugaggccguuaggccgaaaaauuagu

SEQ ID NO: 1187 - RNA, 38 nt, Artificial Sequence
  Description of Artificial Sequence:  Enzymatic Nucleic Acid
aaaaacaccugaugaggccguuaggccgaaaaaauuag

SEQ ID NO: 1188 - RNA, 38 nt, Artificial Sequence
  Description of Artificial Sequence:  Enzymatic Nucleic Acid
uuauuaaacugaugaggccguuaggccgaaacacaaaa

SEQ ID NO: 1189 - RNA, 38 nt, Artificial Sequence
  Description of Artificial Sequence:  Enzymatic Nucleic Acid
uuuauuaacugaugaggccguuaggccgaaaacacaaa

SEQ ID NO: 1190 - RNA, 38 nt, Artificial Sequence
  Description of Artificial Sequence:  Enzymatic Nucleic Acid
cuuuauuacugaugaggccguuaggccgaaaaacacaa

SEQ ID NO: 1191 - RNA, 38 nt, Artificial Sequence
  Description of Artificial Sequence:  Enzymatic Nucleic Acid
ucuuuauucugaugaggccguuaggccgaaaaaacaca

SEQ ID NO: 1192 - RNA, 38 nt, Artificial Sequence
  Description of Artificial Sequence:  Enzymatic Nucleic Acid
gucuuuaucugaugaggccguuaggccgaaaaaaacac

SEQ ID NO: 1193 - RNA, 38 nt, Artificial Sequence
  Description of Artificial Sequence:  Enzymatic Nucleic Acid
ccugucuucugaugaggccguuaggccgaaauuaaaaa

SEQ ID NO: 1194 - RNA, 38 nt, Artificial Sequence
  Description of Artificial Sequence:  Enzymatic Nucleic Acid
cauggugacugaugaggccguuaggccgaaacccuguc

SEQ ID NO: 1195 - RNA, 38 nt, Artificial Sequence
  Description of Artificial Sequence:  Enzymatic Nucleic Acid
acauggugcugaugaggccguuaggccgaaaacccugu

SEQ ID NO: 1196 - RNA, 38 nt, Artificial Sequence
  Description of Artificial Sequence:  Enzymatic Nucleic Acid
aacauggucugaugaggccguuaggccgaaaaacccug

SEQ ID NO: 1197 - RNA, 38 nt, Artificial Sequence
  Description of Artificial Sequence:  Enzymatic Nucleic Acid
gccuggcccugaugaggccguuaggccgaaacauggug

SEQ ID NO: 1198 - RNA, 38 nt, Artificial Sequence
  Description of Artificial Sequence:  Enzymatic Nucleic Acid
gaguuugacugaugaggccguuaggccgaaaccagccu

SEQ ID NO: 1199 - RNA, 38 nt, Artificial Sequence
  Description of Artificial Sequence:  Enzymatic Nucleic Acid
aggaguuucugaugaggccguuaggccgaaagaccagc

SEQ ID NO: 1200 - RNA, 38 nt, Artificial Sequence
  Description of Artificial Sequence:  Enzymatic Nucleic Acid
gaggucagcugaugaggccguuaggccgaaaguuugag

SEQ ID NO: 1201 - RNA, 38 nt, Artificial Sequence
  Description of Artificial Sequence:  Enzymatic Nucleic Acid
gauuacuucugaugaggccguuaggccgaaaggucagg

SEQ ID NO: 1202 - RNA, 38 nt, Artificial Sequence
  Description of Artificial Sequence:  Enzymatic Nucleic Acid
agguggaucugaugaggccguuaggccgaaacuugagg

SEQ ID NO: 1203 - RNA, 38 nt, Artificial Sequence
  Description of Artificial Sequence:  Enzymatic Nucleic Acid
ggcaggugcugaugaggccguuaggccgaaauuacuug

SEQ ID NO: 1204 - RNA, 38 nt, Artificial Sequence
  Description of Artificial Sequence:  Enzymatic Nucleic Acid
gggaggcccugaugaggccguuaggccgaaaggcaggu

SEQ ID NO: 1205 - RNA, 38 nt, Artificial Sequence
  Description of Artificial Sequence:  Enzymatic Nucleic Acid
cacuuuggcugaugaggccguuaggccgaaaggccgag

SEQ ID NO: 1206 - RNA, 38 nt, Artificial Sequence
  Description of Artificial Sequence:  Enzymatic Nucleic Acid
aucccugucugaugaggccguuaggccgaaaucccagc

SEQ ID NO: 1207 - RNA, 38 nt, Artificial Sequence
  Description of Artificial Sequence:  Enzymatic Nucleic Acid
caucccugcugaugaggccguuaggccgaaaaucccag

SEQ ID NO: 1208 - RNA, 38 nt, Artificial Sequence
  Description of Artificial Sequence:  Enzymatic Nucleic Acid
aaagagaucugaugaggccguuaggccgaaaggcuggg

SEQ ID NO: 1209 - RNA, 38 nt, Artificial Sequence
  Description of Artificial Sequence:  Enzymatic Nucleic Acid
aacaaagacugaugaggccguuaggccgaaaugaggcu

SEQ ID NO: 1210 - RNA, 38 nt, Artificial Sequence
  Description of Artificial Sequence:  Enzymatic Nucleic Acid
agaacaaacugaugaggccguuaggccgaaagaugagg

SEQ ID NO: 1211 - RNA, 38 nt, Artificial Sequence
  Description of Artificial Sequence:  Enzymatic Nucleic Acid
uuagaacacugaugaggccguuaggccgaaagagauga

SEQ ID NO: 1212 - RNA, 38 nt, Artificial Sequence
  Description of Artificial Sequence:  Enzymatic Nucleic Acid
uuuagaaccugaugaggccguuaggccgaaaagagaug

SEQ ID NO: 1213 - RNA, 38 nt, Artificial Sequence
  Description of Artificial Sequence:  Enzymatic Nucleic Acid
aucuuuagcugaugaggccguuaggccgaaacaaagag

SEQ ID NO: 1214 - RNA, 38 nt, Artificial Sequence
  Description of Artificial Sequence:  Enzymatic Nucleic Acid
caucuuuacugaugaggccguuaggccgaaaacaaaga

SEQ ID NO: 1215 - RNA, 38 nt, Artificial Sequence
  Description of Artificial Sequence:  Enzymatic Nucleic Acid
uccaucuucugaugaggccguuaggccgaaagaacaaa

SEQ ID NO: 1216 - RNA, 38 nt, Artificial Sequence
  Description of Artificial Sequence:  Enzymatic Nucleic Acid
aaaaagaacugaugaggccguuaggccgaaauuugggg

SEQ ID NO: 1217 - RNA, 38 nt, Artificial Sequence
  Description of Artificial Sequence:  Enzymatic Nucleic Acid
uaaaaagacugaugaggccguuaggccgaaaauuuggg

SEQ ID NO: 1218 - RNA, 38 nt, Artificial Sequence
  Description of Artificial Sequence:  Enzymatic Nucleic Acid
auaaaaagcugaugaggccguuaggccgaaaaauuugg

SEQ ID NO: 1219 - RNA, 38 nt, Artificial Sequence
  Description of Artificial Sequence:  Enzymatic Nucleic Acid
uauaaaaacugaugaggccguuaggccgaaaaaauuug

SEQ ID NO: 1220 - RNA, 38 nt, Artificial Sequence
  Description of Artificial Sequence:  Enzymatic Nucleic Acid
aguauaaacugaugaggccguuaggccgaaagaaaauu

SEQ ID NO: 1221 - RNA, 38 nt, Artificial Sequence
  Description of Artificial Sequence:  Enzymatic Nucleic Acid
uaguauaacugaugaggccguuaggccgaaaagaaaau

SEQ ID NO: 1222 - RNA, 38 nt, Artificial Sequence
  Description of Artificial Sequence:  Enzymatic Nucleic Acid
auaguauacugaugaggccguuaggccgaaaaagaaaa

SEQ ID NO: 1223 - RNA, 38 nt, Artificial Sequence
  Description of Artificial Sequence:  Enzymatic Nucleic Acid
aauaguaucugaugaggccguuaggccgaaaaaagaaa

SEQ ID NO: 1224 - RNA, 38 nt, Artificial Sequence
  Description of Artificial Sequence:  Enzymatic Nucleic Acid
uaauaguacugaugaggccguuaggccgaaaaaaagaa

SEQ ID NO: 1225 - RNA, 38 nt, Artificial Sequence
  Description of Artificial Sequence:  Enzymatic Nucleic Acid
auuaauagcugaugaggccguuaggccgaaauaaaaag

SEQ ID NO: 1226 - RNA, 38 nt, Artificial Sequence
  Description of Artificial Sequence:  Enzymatic Nucleic Acid
uucauuaacugaugaggccguuaggccgaaaguauaaa

SEQ ID NO: 1227 - RNA, 38 nt, Artificial Sequence
  Description of Artificial Sequence:  Enzymatic Nucleic Acid
gauucauucugaugaggccguuaggccgaaauaguaua

SEQ ID NO: 1228 - RNA, 38 nt, Artificial Sequence
  Description of Artificial Sequence:  Enzymatic Nucleic Acid
ugauucaucugaugaggccguuaggccgaaaauaguau

SEQ ID NO: 1229 - RNA, 38 nt, Artificial Sequence
  Description of Artificial Sequence:  Enzymatic Nucleic Acid
aauugauucugaugaggccguuaggccgaaauucauua

SEQ ID NO: 1230 - RNA, 38 nt, Artificial Sequence
  Description of Artificial Sequence:  Enzymatic Nucleic Acid
uaugaauucugaugaggccguuaggccgaaauugauuc

SEQ ID NO: 1231 - RNA, 38 nt, Artificial Sequence
  Description of Artificial Sequence:  Enzymatic Nucleic Acid
uagauaugcugaugaggccguuaggccgaaauugauug

SEQ ID NO: 1232 - RNA, 38 nt, Artificial Sequence
  Description of Artificial Sequence:  Enzymatic Nucleic Acid
auagauaucugaugaggccguuaggccgaaaauugauu

SEQ ID NO: 1233 - RNA, 38 nt, Artificial Sequence
  Description of Artificial Sequence:  Enzymatic Nucleic Acid
uaaauagacugaugaggccguuaggccgaaaugaauug

SEQ ID NO: 1234 - RNA, 38 nt, Artificial Sequence
  Description of Artificial Sequence:  Enzymatic Nucleic Acid
aauaaauacugaugaggccguuaggccgaaauaugaau

SEQ ID NO: 1235 - RNA, 38 nt, Artificial Sequence
  Description of Artificial Sequence:  Enzymatic Nucleic Acid
uuaauaaacugaugaggccguuaggccgaaagauauga

SEQ ID NO: 1236 - RNA, 38 nt, Artificial Sequence
  Description of Artificial Sequence:  Enzymatic Nucleic Acid
auuuaauacugaugaggccguuaggccgaaauagauau

SEQ ID NO: 1237 - RNA, 38 nt, Artificial Sequence
  Description of Artificial Sequence:  Enzymatic Nucleic Acid
aauuuaaucugaugaggccguuaggccgaaaauagaua

SEQ ID NO: 1238 - RNA, 38 nt, Artificial Sequence
  Description of Artificial Sequence:  Enzymatic Nucleic Acid
aaauuuaacugaugaggccguuaggccgaaaaauagau

SEQ ID NO: 1239 - RNA, 38 nt, Artificial Sequence
  Description of Artificial Sequence:  Enzymatic Nucleic Acid
agaaauuucugaugaggccguuaggccgaaauaaauag

SEQ ID NO: 1240 - RNA, 38 nt, Artificial Sequence
  Description of Artificial Sequence:  Enzymatic Nucleic Acid
uagaaauucugaugaggccguuaggccgaaaauaaaua

SEQ ID NO: 1241 - RNA, 38 nt, Artificial Sequence
  Description of Artificial Sequence:  Enzymatic Nucleic Acid
gcgguagacugaugaggccguuaggccgaaauuuaaua

SEQ ID NO: 1242 - RNA, 38 nt, Artificial Sequence
  Description of Artificial Sequence:  Enzymatic Nucleic Acid
agcgguagcugaugaggccguuaggccgaaaauuuaau

SEQ ID NO: 1243 - RNA, 38 nt, Artificial Sequence
  Description of Artificial Sequence:  Enzymatic Nucleic Acid
aagcgguacugaugaggccguuaggccgaaaaauuuaa

SEQ ID NO: 1244 - RNA, 38 nt, Artificial Sequence
  Description of Artificial Sequence:  Enzymatic Nucleic Acid
aaaagcggcugaugaggccguuaggccgaaagaaauuu

SEQ ID NO: 1245 - RNA, 38 nt, Artificial Sequence
  Description of Artificial Sequence:  Enzymatic Nucleic Acid
uggccuaacugaugaggccguuaggccgaaagcgguag

SEQ ID NO: 1246 - RNA, 38 nt, Artificial Sequence
  Description of Artificial Sequence:  Enzymatic Nucleic Acid
uuggccuacugaugaggccguuaggccgaaaagcggua

SEQ ID NO: 1247 - RNA, 38 nt, Artificial Sequence
  Description of Artificial Sequence:  Enzymatic Nucleic Acid
uuuggccucugaugaggccguuaggccgaaaaagcggu

SEQ ID NO: 1248 - RNA, 38 nt, Artificial Sequence
  Description of Artificial Sequence:  Enzymatic Nucleic Acid
uuuuggcccugaugaggccguuaggccgaaaaaagcgg

SEQ ID NO: 1249 - RNA, 38 nt, Artificial Sequence
  Description of Artificial Sequence:  Enzymatic Nucleic Acid
aacgaucucugaugaggccguuaggccgaaacauuuuu

SEQ ID NO: 1250 - RNA, 38 nt, Artificial Sequence
  Description of Artificial Sequence:  Enzymatic Nucleic Acid
cagagaaccugaugaggccguuaggccgaaaucuuaca

SEQ ID NO: 1251 - RNA, 38 nt, Artificial Sequence
  Description of Artificial Sequence:  Enzymatic Nucleic Acid
aggcagagcugaugaggccguuaggccgaaacgaucuu

SEQ ID NO: 1252 - RNA, 38 nt, Artificial Sequence
  Description of Artificial Sequence:  Enzymatic Nucleic Acid
gaggcagacugaugaggccguuaggccgaaaacgaucu

SEQ ID NO: 1253 - RNA, 38 nt, Artificial Sequence
  Description of Artificial Sequence:  Enzymatic Nucleic Acid
gugaggcacugaugaggccguuaggccgaaagaacgau

SEQ ID NO: 1254 - RNA, 38 nt, Artificial Sequence
  Description of Artificial Sequence:  Enzymatic Nucleic Acid
agcuaugucugaugaggccguuaggccgaaaggcagag

SEQ ID NO: 1255 - RNA, 38 nt, Artificial Sequence
  Description of Artificial Sequence:  Enzymatic Nucleic Acid
uuguaagccugaugaggccguuaggccgaaaugugagg

SEQ ID NO: 1256 - RNA, 38 nt, Artificial Sequence
  Description of Artificial Sequence:  Enzymatic Nucleic Acid
uggcuugucugaugaggccguuaggccgaaagcuaugu

SEQ ID NO: 1257 - RNA, 38 nt, Artificial Sequence
  Description of Artificial Sequence:  Enzymatic Nucleic Acid
cuggcuugcugaugaggccguuaggccgaaaagcuaug

SEQ ID NO: 1258 - RNA, 38 nt, Artificial Sequence
  Description of Artificial Sequence:  Enzymatic Nucleic Acid
gaguaccacugaugaggccguuaggccgaaauuucucc

SEQ ID NO: 1259 - RNA, 38 nt, Artificial Sequence
  Description of Artificial Sequence:  Enzymatic Nucleic Acid
uuaaugagcugaugaggccguuaggccgaaaccauauu

SEQ ID NO: 1260 - RNA, 38 nt, Artificial Sequence
  Description of Artificial Sequence:  Enzymatic Nucleic Acid
uuuuuaaucugaugaggccguuaggccgaaaguaccau

SEQ ID NO: 1261 - RNA, 38 nt, Artificial Sequence
  Description of Artificial Sequence:  Enzymatic Nucleic Acid
uuuuuuuucugaugaggccguuaggccgaaaugaguac

SEQ ID NO: 1262 - RNA, 38 nt, Artificial Sequence
  Description of Artificial Sequence:  Enzymatic Nucleic Acid
uuuuuuuucugaugaggccguuaggccgaaaaugagua

SEQ ID NO: 1263 - RNA, 17 nt, Homo sapiens
ggcggcgcaguuugcuc

SEQ ID NO: 1264 - RNA, 17 nt, Homo sapiens
caguuugcucauacuuu

SEQ ID NO: 1265 - RNA, 17 nt, Homo sapiens
guuugcucauacuuugu

SEQ ID NO: 1266 - RNA, 17 nt, Homo sapiens
gcucauacuuugugacu

SEQ ID NO: 1267 - RNA, 17 nt, Homo sapiens
uuugugacuugcgguca

SEQ ID NO: 1268 - RNA, 17 nt, Homo sapiens
uugcggucacaguggca

SEQ ID NO: 1269 - RNA, 17 nt, Homo sapiens
gcggucacaguggcauu

SEQ ID NO: 1270 - RNA, 17 nt, Homo sapiens
acaguggcauucagcuc

SEQ ID NO: 1271 - RNA, 17 nt, Homo sapiens
uggcauucagcuccaca

SEQ ID NO: 1272 - RNA, 17 nt, Homo sapiens
cauucagcuccacacuu

SEQ ID NO: 1273 - RNA, 17 nt, Homo sapiens
uucagcuccacacuugg

SEQ ID NO: 1274 - RNA, 17 nt, Homo sapiens
ucagcuccacacuuggu

SEQ ID NO: 1275 - RNA, 17 nt, Homo sapiens
agcuccacacuugguag

SEQ ID NO: 1276 - RNA, 17 nt, Homo sapiens
cuccacacuugguagaa

SEQ ID NO: 1277 - RNA, 17 nt, Homo sapiens
gguagaaccacaggcac

SEQ ID NO: 1278 - RNA, 17 nt, Homo sapiens
guagaaccacaggcacg

SEQ ID NO: 1279 - RNA, 17 nt, Homo sapiens
agaaccacaggcacgac

SEQ ID NO: 1280 - RNA, 17 nt, Homo sapiens
ccacaggcacgacaagc

SEQ ID NO: 1281 - RNA, 17 nt, Homo sapiens
ggcacgacaagcauaga

SEQ ID NO: 1282 - RNA, 17 nt, Homo sapiens
cgacaagcauagaaaca

SEQ ID NO: 1283 - RNA, 17 nt, Homo sapiens
auagaaacauccuaaac

SEQ ID NO: 1284 - RNA, 17 nt, Homo sapiens
gaaacauccuaaacaau

SEQ ID NO: 1285 - RNA, 17 nt, Homo sapiens
aaacauccuaaacaauc

SEQ ID NO: 1286 - RNA, 17 nt, Homo sapiens
uccuaaacaaucuucau

SEQ ID NO: 1287 - RNA, 17 nt, Homo sapiens
aaacaaucuucaucgag

SEQ ID NO: 1288 - RNA, 17 nt, Homo sapiens
caaucuucaucgaggca

SEQ ID NO: 1289 - RNA, 17 nt, Homo sapiens
aucgaggcaucgagguc

SEQ ID NO: 1290 - RNA, 17 nt, Homo sapiens
ucgagguccaucccaau

SEQ ID NO: 1291 - RNA, 17 nt, Homo sapiens
cgagguccaucccaaua

SEQ ID NO: 1292 - RNA, 17 nt, Homo sapiens
gguccaucccaauaaaa

SEQ ID NO: 1293 - RNA, 17 nt, Homo sapiens
guccaucccaauaaaaa

SEQ ID NO: 1294 - RNA, 17 nt, Homo sapiens
uccaucccaauaaaaau

SEQ ID NO: 1295 - RNA, 17 nt, Homo sapiens
uaaaaaucaggagaccc

SEQ ID NO: 1296 - RNA, 17 nt, Homo sapiens
caggagacccuggcuau

SEQ ID NO: 1297 - RNA, 17 nt, Homo sapiens
aggagacccuggcuauc

SEQ ID NO: 1298 - RNA, 17 nt, Homo sapiens
ggagacccuggcuauca

SEQ ID NO: 1299 - RNA, 17 nt, Homo sapiens
acccuggcuaucauaga

SEQ ID NO: 1300 - RNA, 17 nt, Homo sapiens
uggcuaucauagaccuu

SEQ ID NO: 1301 - RNA, 17 nt, Homo sapiens
ucauagaccuuagucuu

SEQ ID NO: 1302 - RNA, 17 nt, Homo sapiens
cauagaccuuagucuuc

SEQ ID NO: 1303 - RNA, 17 nt, Homo sapiens
ccuuagucuucgcuggu

SEQ ID NO: 1304 - RNA, 17 nt, Homo sapiens
gucuucgcugguauacu

SEQ ID NO: 1305 - RNA, 17 nt, Homo sapiens
ugguauacucgcugucu

SEQ ID NO: 1306 - RNA, 17 nt, Homo sapiens
auacucgcugucuguca

SEQ ID NO: 1307 - RNA, 17 nt, Homo sapiens
ucgcugucugucaacca

SEQ ID NO: 1308 - RNA, 17 nt, Homo sapiens
ugucugucaaccagcgg

SEQ ID NO: 1309 - RNA, 17 nt, Homo sapiens
cugucaaccagcgguug

SEQ ID NO: 1310 - RNA, 17 nt, Homo sapiens
ugucaaccagcgguuga

SEQ ID NO: 1311 - RNA, 17 nt, Homo sapiens
cgguugacuuuuuuuaa

SEQ ID NO: 1312 - RNA, 17 nt, Homo sapiens
uuuuaagccuucuuuuu

SEQ ID NO: 1313 - RNA, 17 nt, Homo sapiens
uuuaagccuucuuuuuu

SEQ ID NO: 1314 - RNA, 17 nt, Homo sapiens
aagccuucuuuuuucuc

SEQ ID NO: 1315 - RNA, 17 nt, Homo sapiens
cuuuuuucucuuuuacc

SEQ ID NO: 1316 - RNA, 17 nt, Homo sapiens
uuuuucucuuuuaccag

SEQ ID NO: 1317 - RNA, 17 nt, Homo sapiens
ucuuuuaccaguuucug

SEQ ID NO: 1318 - RNA, 17 nt, Homo sapiens
cuuuuaccaguuucugg

SEQ ID NO: 1319 - RNA, 17 nt, Homo sapiens
ccaguuucuggagcaaa

SEQ ID NO: 1320 - RNA, 17 nt, Homo sapiens
ucuggagcaaauucagu

SEQ ID NO: 1321 - RNA, 17 nt, Homo sapiens
gcaaauucaguuugccu

SEQ ID NO: 1322 - RNA, 17 nt, Homo sapiens
caguuugccuuccugga

SEQ ID NO: 1323 - RNA, 17 nt, Homo sapiens
aguuugccuuccuggau

SEQ ID NO: 1324 - RNA, 17 nt, Homo sapiens
uugccuuccuggauuug

SEQ ID NO: 1325 - RNA, 17 nt, Homo sapiens
ugccuuccuggauuugu

SEQ ID NO: 1326 - RNA, 17 nt, Homo sapiens
guaaugaccucaaaacu

SEQ ID NO: 1327 - RNA, 17 nt, Homo sapiens
uaaugaccucaaaacuu

SEQ ID NO: 1328 - RNA, 17 nt, Homo sapiens
augaccucaaaacuuua

SEQ ID NO: 1329 - RNA, 17 nt, Homo sapiens
cucaaaacuuuagcagu

SEQ ID NO: 1330 - RNA, 17 nt, Homo sapiens
acuuuagcaguucuucc

SEQ ID NO: 1331 - RNA, 17 nt, Homo sapiens
agcaguucuuccaucug

SEQ ID NO: 1332 - RNA, 17 nt, Homo sapiens
aguucuuccaucugacu

SEQ ID NO: 1333 - RNA, 17 nt, Homo sapiens
guucuuccaucugacuc

SEQ ID NO: 1334 - RNA, 17 nt, Homo sapiens
cuuccaucugacucagg

SEQ ID NO: 1335 - RNA, 17 nt, Homo sapiens
caucugacucagguuug

SEQ ID NO: 1336 - RNA, 17 nt, Homo sapiens
ucugacucagguuugcu

SEQ ID NO: 1337 - RNA, 17 nt, Homo sapiens
agguuugcuucucuggc

SEQ ID NO: 1338 - RNA, 17 nt, Homo sapiens
uuugcuucucuggcggu

SEQ ID NO: 1339 - RNA, 17 nt, Homo sapiens
ugcuucucuggcggucu

SEQ ID NO: 1340 - RNA, 17 nt, Homo sapiens
uggcggucuucagaauc

SEQ ID NO: 1341 - RNA, 17 nt, Homo sapiens
cggucuucagaaucaac

SEQ ID NO: 1342 - RNA, 17 nt, Homo sapiens
ucagaaucaacauccac

SEQ ID NO: 1343 - RNA, 17 nt, Homo sapiens
gaaucaacauccacacu

SEQ ID NO: 1344 - RNA, 17 nt, Homo sapiens
ucaacauccacacuucc

SEQ ID NO: 1345 - RNA, 17 nt, Homo sapiens
caacauccacacuuccg

SEQ ID NO: 1346 - RNA, 17 nt, Homo sapiens
acauccacacuuccgug

SEQ ID NO: 1347 - RNA, 17 nt, Homo sapiens
auccacacuuccgugau

SEQ ID NO: 1348 - RNA, 17 nt, Homo sapiens
cacacuuccgugauuau

SEQ ID NO: 1349 - RNA, 17 nt, Homo sapiens
ugauuaucugcgugcau

SEQ ID NO: 1350 - RNA, 17 nt, Homo sapiens
cugcgugcauuuuggac

SEQ ID NO: 1351 - RNA, 17 nt, Homo sapiens
uuuuggacaaagcuucc

SEQ ID NO: 1352 - RNA, 17 nt, Homo sapiens
gacaaagcuuccaacca

SEQ ID NO: 1353 - RNA, 17 nt, Homo sapiens
aaagcuuccaaccagga

SEQ ID NO: 1354 - RNA, 17 nt, Homo sapiens
aagcuuccaaccaggau

SEQ ID NO: 1355 - RNA, 17 nt, Homo sapiens
cuuccaaccaggauacg

SEQ ID NO: 1356 - RNA, 17 nt, Homo sapiens
uuccaaccaggauacgg

SEQ ID NO: 1357 - RNA, 17 nt, Homo sapiens
gaaauggcuggugaucu

SEQ ID NO: 1358 - RNA, 17 nt, Homo sapiens
uggugaucuuucagcag

SEQ ID NO: 1359 - RNA, 17 nt, Homo sapiens
gaucuuucagcagguuu

SEQ ID NO: 1360 - RNA, 17 nt, Homo sapiens
cuuucagcagguuucuu

SEQ ID NO: 1361 - RNA, 17 nt, Homo sapiens
cagguuucuucauggag

SEQ ID NO: 1362 - RNA, 17 nt, Homo sapiens
guuucuucauggaggaa

SEQ ID NO: 1363 - RNA, 17 nt, Homo sapiens
ggaggaacuuaauacau

SEQ ID NO: 1364 - RNA, 17 nt, Homo sapiens
cuuaauacauaccguca

SEQ ID NO: 1365 - RNA, 17 nt, Homo sapiens
auacauaccgucagaag

SEQ ID NO: 1366 - RNA, 17 nt, Homo sapiens
auaccgucagaagcagg

SEQ ID NO: 1367 - RNA, 17 nt, Homo sapiens
ucagaagcagggaguag

SEQ ID NO: 1368 - RNA, 17 nt, Homo sapiens
aguaguacuuaaauauc

SEQ ID NO: 1369 - RNA, 17 nt, Homo sapiens
uaaauaucaagaacugc

SEQ ID NO: 1370 - RNA, 17 nt, Homo sapiens
ucaagaacugccuaauu

SEQ ID NO: 1371 - RNA, 17 nt, Homo sapiens
agaacugccuaauucag

SEQ ID NO: 1372 - RNA, 17 nt, Homo sapiens
gaacugccuaauucagg

SEQ ID NO: 1373 - RNA, 17 nt, Homo sapiens
ccuaauucaggaccucc

SEQ ID NO: 1374 - RNA, 17 nt, Homo sapiens
uucaggaccuccacaug

SEQ ID NO: 1375 - RNA, 17 nt, Homo sapiens
ucaggaccuccacauga

SEQ ID NO: 1376 - RNA, 17 nt, Homo sapiens
aggaccuccacaugaua

SEQ ID NO: 1377 - RNA, 17 nt, Homo sapiens
ggaccuccacaugauag

SEQ ID NO: 1378 - RNA, 17 nt, Homo sapiens
accuccacaugauagga

SEQ ID NO: 1379 - RNA, 17 nt, Homo sapiens
agguuuacauuucaagu

SEQ ID NO: 1380 - RNA, 17 nt, Homo sapiens
uacauuucaaguuauaa

SEQ ID NO: 1381 - RNA, 17 nt, Homo sapiens
agaauuuccagaaggug

SEQ ID NO: 1382 - RNA, 17 nt, Homo sapiens
gaauuuccagaagguga

SEQ ID NO: 1383 - RNA, 17 nt, Homo sapiens
gguagaucaaagaagga

SEQ ID NO: 1384 - RNA, 17 nt, Homo sapiens
aaggaagcaaaaaaugc

SEQ ID NO: 1385 - RNA, 17 nt, Homo sapiens
aaaaaugccgcagccaa

SEQ ID NO: 1386 - RNA, 17 nt, Homo sapiens
aaugccgcagccaaauu

SEQ ID NO: 1387 - RNA, 17 nt, Homo sapiens
gccgcagccaaauuagc

SEQ ID NO: 1388 - RNA, 17 nt, Homo sapiens
ccgcagccaaauuagcu

SEQ ID NO: 1389 - RNA, 17 nt, Homo sapiens
aaauuagcuguugagau

SEQ ID NO: 1390 - RNA, 17 nt, Homo sapiens
ugagauacuuaauaagg

SEQ ID NO: 1391 - RNA, 17 nt, Homo sapiens
aagaaggcaguuagucc

SEQ ID NO: 1392 - RNA, 17 nt, Homo sapiens
aguuaguccuuuauuau

SEQ ID NO: 1393 - RNA, 17 nt, Homo sapiens
guuaguccuuuauuauu

SEQ ID NO: 1394 - RNA, 17 nt, Homo sapiens
uuauugacaacaacgaa

SEQ ID NO: 1395 - RNA, 17 nt, Homo sapiens
uugacaacaacgaauuc

SEQ ID NO: 1396 - RNA, 17 nt, Homo sapiens
acgaauucuucagaagg

SEQ ID NO: 1397 - RNA, 17 nt, Homo sapiens
aauucuucagaaggauu

SEQ ID NO: 1398 - RNA, 17 nt, Homo sapiens
ggauuauccauggggaa

SEQ ID NO: 1399 - RNA, 17 nt, Homo sapiens
gauuauccauggggaau

SEQ ID NO: 1400 - RNA, 17 nt, Homo sapiens
ggaauuacauaggccuu

SEQ ID NO: 1401 - RNA, 17 nt, Homo sapiens
acauaggccuuaucaau

SEQ ID NO: 1402 - RNA, 17 nt, Homo sapiens
cauaggccuuaucaaua

SEQ ID NO: 1403 - RNA, 17 nt, Homo sapiens
gccuuaucaauagaauu

SEQ ID NO: 1404 - RNA, 17 nt, Homo sapiens
agaauugcccagaagaa

SEQ ID NO: 1405 - RNA, 17 nt, Homo sapiens
gaauugcccagaagaaa

SEQ ID NO: 1406 - RNA, 17 nt, Homo sapiens
aauugcccagaagaaaa

SEQ ID NO: 1407 - RNA, 17 nt, Homo sapiens
gaaaagacuaacuguaa

SEQ ID NO: 1408 - RNA, 17 nt, Homo sapiens
agacuaacuguaaauua

SEQ ID NO: 1409 - RNA, 17 nt, Homo sapiens
uuaugaacagugugcau

SEQ ID NO: 1410 - RNA, 17 nt, Homo sapiens
cagugugcaucgggggu

SEQ ID NO: 1411 - RNA, 17 nt, Homo sapiens
gggggugcaugggccag

SEQ ID NO: 1412 - RNA, 17 nt, Homo sapiens
gcaugggccagaaggau

SEQ ID NO: 1413 - RNA, 17 nt, Homo sapiens
caugggccagaaggauu

SEQ ID NO: 1414 - RNA, 17 nt, Homo sapiens
aggauuucauuauaaau

SEQ ID NO: 1415 - RNA, 17 nt, Homo sapiens
auaaaugcaaaauggga

SEQ ID NO: 1416 - RNA, 17 nt, Homo sapiens
aaugggacagaaagaau

SEQ ID NO: 1417 - RNA, 17 nt, Homo sapiens
auugguacagguucuac

SEQ ID NO: 1418 - RNA, 17 nt, Homo sapiens
acagguucuacuaaaca

SEQ ID NO: 1419 - RNA, 17 nt, Homo sapiens
gguucuacuaaacagga

SEQ ID NO: 1420 - RNA, 17 nt, Homo sapiens
uacuaaacaggaagcaa

SEQ ID NO: 1421 - RNA, 17 nt, Homo sapiens
caggaagcaaaacaauu

SEQ ID NO: 1422 - RNA, 17 nt, Homo sapiens
agcaaaacaauuggccg

SEQ ID NO: 1423 - RNA, 17 nt, Homo sapiens
caauuggccgcuaaacu

SEQ ID NO: 1424 - RNA, 17 nt, Homo sapiens
uuggccgcuaaacuugc

SEQ ID NO: 1425 - RNA, 17 nt, Homo sapiens
cgcuaaacuugcauauc

SEQ ID NO: 1426 - RNA, 17 nt, Homo sapiens
aaacuugcauaucuuca

SEQ ID NO: 1427 - RNA, 17 nt, Homo sapiens
ugcauaucuucagauau

SEQ ID NO: 1428 - RNA, 17 nt, Homo sapiens
auaucuucagauauuau

SEQ ID NO: 1429 - RNA, 17 nt, Homo sapiens
auauuaucagaagaaac

SEQ ID NO: 1430 - RNA, 17 nt, Homo sapiens
gaagaaaccucagugaa

SEQ ID NO: 1431 - RNA, 17 nt, Homo sapiens
aagaaaccucagugaaa

SEQ ID NO: 1432 - RNA, 17 nt, Homo sapiens
gaaaccucagugaaauc

SEQ ID NO: 1433 - RNA, 17 nt, Homo sapiens
gugaaaucugacuaccu

SEQ ID NO: 1434 - RNA, 17 nt, Homo sapiens
aaucugacuaccugucc

SEQ ID NO: 1435 - RNA, 17 nt, Homo sapiens
cugacuaccuguccucu

SEQ ID NO: 1436 - RNA, 17 nt, Homo sapiens
ugacuaccuguccucug

SEQ ID NO: 1437 - RNA, 17 nt, Homo sapiens
uaccuguccucugguuc

SEQ ID NO: 1438 - RNA, 17 nt, Homo sapiens
accuguccucugguucu

SEQ ID NO: 1439 - RNA, 17 nt, Homo sapiens
cuguccucugguucuuu

SEQ ID NO: 1440 - RNA, 17 nt, Homo sapiens
ucugguucuuuugcuac

SEQ ID NO: 1441 - RNA, 17 nt, Homo sapiens
ucuuuugcuacuacgug

SEQ ID NO: 1442 - RNA, 17 nt, Homo sapiens
uuugcuacuacguguga

SEQ ID NO: 1443 - RNA, 17 nt, Homo sapiens
ugugagucccaaagcaa

SEQ ID NO: 1444 - RNA, 17 nt, Homo sapiens
gugagucccaaagcaac

SEQ ID NO: 1445 - RNA, 17 nt, Homo sapiens
ugagucccaaagcaacu

SEQ ID NO: 1446 - RNA, 17 nt, Homo sapiens
cccaaagcaacucuuua

SEQ ID NO: 1447 - RNA, 17 nt, Homo sapiens
aaagcaacucuuuagug

SEQ ID NO: 1448 - RNA, 17 nt, Homo sapiens
agcaacucuuuagugac

SEQ ID NO: 1449 - RNA, 17 nt, Homo sapiens
uuagugaccagcacacu

SEQ ID NO: 1450 - RNA, 17 nt, Homo sapiens
uagugaccagcacacuc

SEQ ID NO: 1451 - RNA, 17 nt, Homo sapiens
ugaccagcacacucgcu

SEQ ID NO: 1452 - RNA, 17 nt, Homo sapiens
accagcacacucgcuuc

SEQ ID NO: 1453 - RNA, 17 nt, Homo sapiens
cagcacacucgcuucug

SEQ ID NO: 1454 - RNA, 17 nt, Homo sapiens
acacucgcuucugaauc

SEQ ID NO: 1455 - RNA, 17 nt, Homo sapiens
cucgcuucugaaucauc

SEQ ID NO: 1456 - RNA, 17 nt, Homo sapiens
ucugaaucaucaucuga

SEQ ID NO: 1457 - RNA, 17 nt, Homo sapiens
gaaucaucaucugaagg

SEQ ID NO: 1458 - RNA, 17 nt, Homo sapiens
ucaucaucugaagguga

SEQ ID NO: 1459 - RNA, 17 nt, Homo sapiens
aaggugacuucucagca

SEQ ID NO: 1460 - RNA, 17 nt, Homo sapiens
gugacuucucagcagau

SEQ ID NO: 1461 - RNA, 17 nt, Homo sapiens
gacuucucagcagauac

SEQ ID NO: 1462 - RNA, 17 nt, Homo sapiens
uucucagcagauacauc

SEQ ID NO: 1463 - RNA, 17 nt, Homo sapiens
gcagauacaucagagau

SEQ ID NO: 1464 - RNA, 17 nt, Homo sapiens
gauacaucagagauaaa

SEQ ID NO: 1465 - RNA, 17 nt, Homo sapiens
auaaauucuaacaguga

SEQ ID NO: 1466 - RNA, 17 nt, Homo sapiens
auucuaacagugacagu

SEQ ID NO: 1467 - RNA, 17 nt, Homo sapiens
acagugacaguuuaaac

SEQ ID NO: 1468 - RNA, 17 nt, Homo sapiens
guuuaaacaguucuucg

SEQ ID NO: 1469 - RNA, 17 nt, Homo sapiens
aacaguucuucguugcu

SEQ ID NO: 1470 - RNA, 17 nt, Homo sapiens
uucguugcuuaugaaug

SEQ ID NO: 1471 - RNA, 17 nt, Homo sapiens
gaauggucucagaaaua

SEQ ID NO: 1472 - RNA, 17 nt, Homo sapiens
auggucucagaaauaau

SEQ ID NO: 1473 - RNA, 17 nt, Homo sapiens
aaauaaucaaaggaagg

SEQ ID NO: 1474 - RNA, 17 nt, Homo sapiens
aggaaggcaaaaagauc

SEQ ID NO: 1475 - RNA, 17 nt, Homo sapiens
aaaagaucuuuggcacc

SEQ ID NO: 1476 - RNA, 17 nt, Homo sapiens
ucuuuggcacccagauu

SEQ ID NO: 1477 - RNA, 17 nt, Homo sapiens
uuuggcacccagauuug

SEQ ID NO: 1478 - RNA, 17 nt, Homo sapiens
uuggcacccagauuuga

SEQ ID NO: 1479 - RNA, 17 nt, Homo sapiens
uggcacccagauuugac

SEQ ID NO: 1480 - RNA, 17 nt, Homo sapiens
gauuugaccuuccugac

SEQ ID NO: 1481 - RNA, 17 nt, Homo sapiens
auuugaccuuccugaca

SEQ ID NO: 1482 - RNA, 17 nt, Homo sapiens
ugaccuuccugacauga

SEQ ID NO: 1483 - RNA, 17 nt, Homo sapiens
gaccuuccugacaugaa

SEQ ID NO: 1484 - RNA, 17 nt, Homo sapiens
uuccugacaugaaagaa

SEQ ID NO: 1485 - RNA, 17 nt, Homo sapiens
aaagaaacaaaguauac

SEQ ID NO: 1486 - RNA, 17 nt, Homo sapiens
aaguauacuguggacaa

SEQ ID NO: 1487 - RNA, 17 nt, Homo sapiens
cuguggacaagagguuu

SEQ ID NO: 1488 - RNA, 17 nt, Homo sapiens
gguuuggcauggauuuu

SEQ ID NO: 1489 - RNA, 17 nt, Homo sapiens
uaauuggcucaggugga

SEQ ID NO: 1490 - RNA, 17 nt, Homo sapiens
auuggcucagguggauu

SEQ ID NO: 1491 - RNA, 17 nt, Homo sapiens
gauuuggccaaguuuuc

SEQ ID NO: 1492 - RNA, 17 nt, Homo sapiens
auuuggccaaguuuuca

SEQ ID NO: 1493 - RNA, 17 nt, Homo sapiens
aaguuuucaaagcaaaa

SEQ ID NO: 1494 - RNA, 17 nt, Homo sapiens
uucaaagcaaaacacag

SEQ ID NO: 1495 - RNA, 17 nt, Homo sapiens
agcaaaacacagaauug

SEQ ID NO: 1496 - RNA, 17 nt, Homo sapiens
caaaacacagaauugac

SEQ ID NO: 1497 - RNA, 17 nt, Homo sapiens
ggaaagacuuacguuau

SEQ ID NO: 1498 - RNA, 17 nt, Homo sapiens
guaaaagcauuggcaaa

SEQ ID NO: 1499 - RNA, 17 nt, Homo sapiens
gcauuggcaaaacuuga

SEQ ID NO: 1500 - RNA, 17 nt, Homo sapiens
ggcaaaacuugaucaug

SEQ ID NO: 1501 - RNA, 17 nt, Homo sapiens
acuugaucauguaaaua

SEQ ID NO: 1502 - RNA, 17 nt, Homo sapiens
uauuguucacuacaaug

SEQ ID NO: 1503 - RNA, 17 nt, Homo sapiens
uuguucacuacaauggc

SEQ ID NO: 1504 - RNA, 17 nt, Homo sapiens
uucacuacaauggcugu

SEQ ID NO: 1505 - RNA, 17 nt, Homo sapiens
acaauggcuguugggau

SEQ ID NO: 1506 - RNA, 17 nt, Homo sapiens
uuaugauccugagacca

SEQ ID NO: 1507 - RNA, 17 nt, Homo sapiens
uaugauccugagaccag

SEQ ID NO: 1508 - RNA, 17 nt, Homo sapiens
ccugagaccagugauga

SEQ ID NO: 1509 - RNA, 17 nt, Homo sapiens
cugagaccagugaugau

SEQ ID NO: 1510 - RNA, 17 nt, Homo sapiens
gaugauucucuugagag

SEQ ID NO: 1511 - RNA, 17 nt, Homo sapiens
ugauucucuugagagca

SEQ ID NO: 1512 - RNA, 17 nt, Homo sapiens
uugagagcagugauuau

SEQ ID NO: 1513 - RNA, 17 nt, Homo sapiens
uuaugauccugagaaca

SEQ ID NO: 1514 - RNA, 17 nt, Homo sapiens
uaugauccugagaacag

SEQ ID NO: 1515 - RNA, 17 nt, Homo sapiens
cugagaacagcaaaaau

SEQ ID NO: 1516 - RNA, 17 nt, Homo sapiens
agaacagcaaaaauagu

SEQ ID NO: 1517 - RNA, 17 nt, Homo sapiens
aauaguucaaggucaaa

SEQ ID NO: 1518 - RNA, 17 nt, Homo sapiens
ucaaggucaaagacuaa

SEQ ID NO: 1519 - RNA, 17 nt, Homo sapiens
ucaaagacuaagugccu

SEQ ID NO: 1520 - RNA, 17 nt, Homo sapiens
cuaagugccuuuucauc

SEQ ID NO: 1521 - RNA, 17 nt, Homo sapiens
uaagugccuuuucaucc

SEQ ID NO: 1522 - RNA, 17 nt, Homo sapiens
gccuuuucauccaaaug

SEQ ID NO: 1523 - RNA, 17 nt, Homo sapiens
uuuucauccaaauggaa

SEQ ID NO: 1524 - RNA, 17 nt, Homo sapiens
uuucauccaaauggaau

SEQ ID NO: 1525 - RNA, 17 nt, Homo sapiens
uggaauucugugauaaa

SEQ ID NO: 1526 - RNA, 17 nt, Homo sapiens
aaagggaccuuggaaca

SEQ ID NO: 1527 - RNA, 17 nt, Homo sapiens
aagggaccuuggaacaa

SEQ ID NO: 1528 - RNA, 17 nt, Homo sapiens
cuuggaacaauggauug

SEQ ID NO: 1529 - RNA, 17 nt, Homo sapiens
cgagaaacuagacaaag

SEQ ID NO: 1530 - RNA, 17 nt, Homo sapiens
aacuagacaaaguuuug

SEQ ID NO: 1531 - RNA, 17 nt, Homo sapiens
guuuuggcuuuggaacu

SEQ ID NO: 1532 - RNA, 17 nt, Homo sapiens
uuuggaacucuuugaac

SEQ ID NO: 1533 - RNA, 17 nt, Homo sapiens
uggaacucuuugaacaa

SEQ ID NO: 1534 - RNA, 17 nt, Homo sapiens
cuuugaacaaauaacaa

SEQ ID NO: 1535 - RNA, 17 nt, Homo sapiens
caaauaacaaaaggggu

SEQ ID NO: 1536 - RNA, 17 nt, Homo sapiens
uuauauacauucaaaaa

SEQ ID NO: 1537 - RNA, 17 nt, Homo sapiens
auacauucaaaaaaauu

SEQ ID NO: 1538 - RNA, 17 nt, Homo sapiens
auuaauucauagagauc

SEQ ID NO: 1539 - RNA, 17 nt, Homo sapiens
uagagaucuuaagccaa

SEQ ID NO: 1540 - RNA, 17 nt, Homo sapiens
ucuuaagccaaguaaua

SEQ ID NO: 1541 - RNA, 17 nt, Homo sapiens
cuuaagccaaguaauau

SEQ ID NO: 1542 - RNA, 17 nt, Homo sapiens
auauauucuuaguagau

SEQ ID NO: 1543 - RNA, 17 nt, Homo sapiens
guagauacaaaacaagu

SEQ ID NO: 1544 - RNA, 17 nt, Homo sapiens
uacaaaacaaguaaaga

SEQ ID NO: 1545 - RNA, 17 nt, Homo sapiens
uuggagacuuuggacuu

SEQ ID NO: 1546 - RNA, 17 nt, Homo sapiens
cuuuggacuuguaacau

SEQ ID NO: 1547 - RNA, 17 nt, Homo sapiens
cuuguaacaucucugaa

SEQ ID NO: 1548 - RNA, 17 nt, Homo sapiens
guaacaucucugaaaaa

SEQ ID NO: 1549 - RNA, 17 nt, Homo sapiens
aacaucucugaaaaaug

SEQ ID NO: 1550 - RNA, 17 nt, Homo sapiens
aagcgaacaaggaguaa

SEQ ID NO: 1551 - RNA, 17 nt, Homo sapiens
aagggaacuuugcgaua

SEQ ID NO: 1552 - RNA, 17 nt, Homo sapiens
ugcgauacaugagccca

SEQ ID NO: 1553 - RNA, 17 nt, Homo sapiens
acaugagcccagaacag

SEQ ID NO: 1554 - RNA, 17 nt, Homo sapiens
caugagcccagaacaga

SEQ ID NO: 1555 - RNA, 17 nt, Homo sapiens
augagcccagaacagau

SEQ ID NO: 1556 - RNA, 17 nt, Homo sapiens
cccagaacagauuucuu

SEQ ID NO: 1557 - RNA, 17 nt, Homo sapiens
cagauuucuucgcaaga

SEQ ID NO: 1558 - RNA, 17 nt, Homo sapiens
uucuucgcaagacuaug

SEQ ID NO: 1559 - RNA, 17 nt, Homo sapiens
cgcaagacuauggaaag

SEQ ID NO: 1560 - RNA, 17 nt, Homo sapiens
aaguggaccucuacgcu

SEQ ID NO: 1561 - RNA, 17 nt, Homo sapiens
aguggaccucuacgcuu

SEQ ID NO: 1562 - RNA, 17 nt, Homo sapiens
uggaccucuacgcuuug

SEQ ID NO: 1563 - RNA, 17 nt, Homo sapiens
cucuacgcuuuggggcu

SEQ ID NO: 1564 - RNA, 17 nt, Homo sapiens
uuuggggcuaauucuug

SEQ ID NO: 1565 - RNA, 17 nt, Homo sapiens
gcuaauucuugcugaac

SEQ ID NO: 1566 - RNA, 17 nt, Homo sapiens
auucuugcugaacuucu

SEQ ID NO: 1567 - RNA, 17 nt, Homo sapiens
ugcugaacuucuucaug

SEQ ID NO: 1568 - RNA, 17 nt, Homo sapiens
ugaacuucuucauguau

SEQ ID NO: 1569 - RNA, 17 nt, Homo sapiens
acuucuucauguaugug

SEQ ID NO: 1570 - RNA, 17 nt, Homo sapiens
uaugugacacugcuuuu

SEQ ID NO: 1571 - RNA, 17 nt, Homo sapiens
ugugacacugcuuuuga

SEQ ID NO: 1572 - RNA, 17 nt, Homo sapiens
gacacugcuuuugaaac

SEQ ID NO: 1573 - RNA, 17 nt, Homo sapiens
uuugaaacaucaaaguu

SEQ ID NO: 1574 - RNA, 17 nt, Homo sapiens
gaaacaucaaaguuuuu

SEQ ID NO: 1575 - RNA, 17 nt, Homo sapiens
aguuuuucacagaccua

SEQ ID NO: 1576 - RNA, 17 nt, Homo sapiens
uuuuucacagaccuacg

SEQ ID NO: 1577 - RNA, 17 nt, Homo sapiens
ucacagaccuacgggau

SEQ ID NO: 1578 - RNA, 17 nt, Homo sapiens
cacagaccuacgggaug

SEQ ID NO: 1579 - RNA, 17 nt, Homo sapiens
gggauggcaucaucuca

SEQ ID NO: 1580 - RNA, 17 nt, Homo sapiens
auggcaucaucucagau

SEQ ID NO: 1581 - RNA, 17 nt, Homo sapiens
gcaucaucucagauaua

SEQ ID NO: 1582 - RNA, 17 nt, Homo sapiens
aucaucucagauauauu

SEQ ID NO: 1583 - RNA, 17 nt, Homo sapiens
gaaaaaacucuucuaca

SEQ ID NO: 1584 - RNA, 17 nt, Homo sapiens
aaaaacucuucuacaga

SEQ ID NO: 1585 - RNA, 17 nt, Homo sapiens
aacucuucuacagaaau

SEQ ID NO: 1586 - RNA, 17 nt, Homo sapiens
ucuucuacagaaauuac

SEQ ID NO: 1587 - RNA, 17 nt, Homo sapiens
gaaauuacucucaaaga

SEQ ID NO: 1588 - RNA, 17 nt, Homo sapiens
aauuacucucaaagaaa

SEQ ID NO: 1589 - RNA, 17 nt, Homo sapiens
uuacucucaaagaaacc

SEQ ID NO: 1590 - RNA, 17 nt, Homo sapiens
aaagaaaccugaggauc

SEQ ID NO: 1591 - RNA, 17 nt, Homo sapiens
aagaaaccugaggaucg

SEQ ID NO: 1592 - RNA, 17 nt, Homo sapiens
ggaucgaccuaacacau

SEQ ID NO: 1593 - RNA, 17 nt, Homo sapiens
gaucgaccuaacacauc

SEQ ID NO: 1594 - RNA, 17 nt, Homo sapiens
gaccuaacacaucugaa

SEQ ID NO: 1595 - RNA, 17 nt, Homo sapiens
ccuaacacaucugaaau

SEQ ID NO: 1596 - RNA, 17 nt, Homo sapiens
aacacaucugaaauacu

SEQ ID NO: 1597 - RNA, 17 nt, Homo sapiens
ugaaauacuaaggaccu

SEQ ID NO: 1598 - RNA, 17 nt, Homo sapiens
cuaaggaccuugacugu

SEQ ID NO: 1599 - RNA, 17 nt, Homo sapiens
uaaggaccuugacugug

SEQ ID NO: 1600 - RNA, 17 nt, Homo sapiens
accuugacuguguggaa

SEQ ID NO: 1601 - RNA, 17 nt, Homo sapiens
agaaaagcccagagaaa

SEQ ID NO: 1602 - RNA, 17 nt, Homo sapiens
gaaaagcccagagaaaa

SEQ ID NO: 1603 - RNA, 17 nt, Homo sapiens
aaaagcccagagaaaaa

SEQ ID NO: 1604 - RNA, 17 nt, Homo sapiens
ugaacgacacacauguu

SEQ ID NO: 1605 - RNA, 17 nt, Homo sapiens
aacgacacacauguuag

SEQ ID NO: 1606 - RNA, 17 nt, Homo sapiens
cgacacacauguuagag

SEQ ID NO: 1607 - RNA, 17 nt, Homo sapiens
guuagagcccuucugaa

SEQ ID NO: 1608 - RNA, 17 nt, Homo sapiens
uuagagcccuucugaaa

SEQ ID NO: 1609 - RNA, 17 nt, Homo sapiens
uagagcccuucugaaaa

SEQ ID NO: 1610 - RNA, 17 nt, Homo sapiens
agcccuucugaaaaagu

SEQ ID NO: 1611 - RNA, 17 nt, Homo sapiens
aaaguauccugcuucug

SEQ ID NO: 1612 - RNA, 17 nt, Homo sapiens
aaguauccugcuucuga

SEQ ID NO: 1613 - RNA, 17 nt, Homo sapiens
uauccugcuucugauau

SEQ ID NO: 1614 - RNA, 17 nt, Homo sapiens
ccugcuucugauaugca

SEQ ID NO: 1615 - RNA, 17 nt, Homo sapiens
ugauaugcaguuuuccu

SEQ ID NO: 1616 - RNA, 17 nt, Homo sapiens
caguuuuccuuaaauua

SEQ ID NO: 1617 - RNA, 17 nt, Homo sapiens
aguuuuccuuaaauuau

SEQ ID NO: 1618 - RNA, 17 nt, Homo sapiens
aaauuaucuaaaaucug

SEQ ID NO: 1619 - RNA, 17 nt, Homo sapiens
cuaaaaucugcuaggga

SEQ ID NO: 1620 - RNA, 17 nt, Homo sapiens
aaaucugcuagggaaua

SEQ ID NO: 1621 - RNA, 17 nt, Homo sapiens
ggaauaucaauagauau

SEQ ID NO: 1622 - RNA, 17 nt, Homo sapiens
auauuuaccuuuuauuu

SEQ ID NO: 1623 - RNA, 17 nt, Homo sapiens
uauuuaccuuuuauuuu

SEQ ID NO: 1624 - RNA, 17 nt, Homo sapiens
aauguuuccuuuaauuu

SEQ ID NO: 1625 - RNA, 17 nt, Homo sapiens
auguuuccuuuaauuuu

SEQ ID NO: 1626 - RNA, 17 nt, Homo sapiens
uuuuuuacuauuuuuac

SEQ ID NO: 1627 - RNA, 17 nt, Homo sapiens
auuuuuacuaaucuuuc

SEQ ID NO: 1628 - RNA, 17 nt, Homo sapiens
uacuaaucuuucugcag

SEQ ID NO: 1629 - RNA, 17 nt, Homo sapiens
aaucuuucugcagaaac

SEQ ID NO: 1630 - RNA, 17 nt, Homo sapiens
cuuucugcagaaacaga

SEQ ID NO: 1631 - RNA, 17 nt, Homo sapiens
gcagaaacagaaagguu

SEQ ID NO: 1632 - RNA, 17 nt, Homo sapiens
agguuuucuucuuuuug

SEQ ID NO: 1633 - RNA, 17 nt, Homo sapiens
uuuucuucuuuuugcuu

SEQ ID NO: 1634 - RNA, 17 nt, Homo sapiens
cuuuuugcuucaaaaac

SEQ ID NO: 1635 - RNA, 17 nt, Homo sapiens
uuugcuucaaaaacauu

SEQ ID NO: 1636 - RNA, 17 nt, Homo sapiens
ucaaaaacauucuuaca

SEQ ID NO: 1637 - RNA, 17 nt, Homo sapiens
aaacauucuuacauuuu

SEQ ID NO: 1638 - RNA, 17 nt, Homo sapiens
auucuuacauuuuacuu

SEQ ID NO: 1639 - RNA, 17 nt, Homo sapiens
cauuuuacuuuuuccug

SEQ ID NO: 1640 - RNA, 17 nt, Homo sapiens
acuuuuuccuggcucau

SEQ ID NO: 1641 - RNA, 17 nt, Homo sapiens
cuuuuuccuggcucauc

SEQ ID NO: 1642 - RNA, 17 nt, Homo sapiens
uuccuggcucaucucuu

SEQ ID NO: 1643 - RNA, 17 nt, Homo sapiens
ccuggcucaucucuuua

SEQ ID NO: 1644 - RNA, 17 nt, Homo sapiens
ggcucaucucuuuauuc

SEQ ID NO: 1645 - RNA, 17 nt, Homo sapiens
cucaucucuuuauucuu

SEQ ID NO: 1646 - RNA, 17 nt, Homo sapiens
cuuuauucuuuuuuuuu

SEQ ID NO: 1647 - RNA, 17 nt, Homo sapiens
uuaaagacagagucucg

SEQ ID NO: 1648 - RNA, 17 nt, Homo sapiens
acagagucucgcucugu

SEQ ID NO: 1649 - RNA, 17 nt, Homo sapiens
agucucgcucuguugcc

SEQ ID NO: 1650 - RNA, 17 nt, Homo sapiens
ucucgcucuguugccca

SEQ ID NO: 1651 - RNA, 17 nt, Homo sapiens
ucuguugcccaggcugg

SEQ ID NO: 1652 - RNA, 17 nt, Homo sapiens
cuguugcccaggcugga

SEQ ID NO: 1653 - RNA, 17 nt, Homo sapiens
uguugcccaggcuggag

SEQ ID NO: 1654 - RNA, 17 nt, Homo sapiens
gcccaggcuggagugca

SEQ ID NO: 1655 - RNA, 17 nt, Homo sapiens
uggagugcaaugacaca

SEQ ID NO: 1656 - RNA, 17 nt, Homo sapiens
gcaaugacacagucuug

SEQ ID NO: 1657 - RNA, 17 nt, Homo sapiens
aaugacacagucuuggc

SEQ ID NO: 1658 - RNA, 17 nt, Homo sapiens
acacagucuuggcucac

SEQ ID NO: 1659 - RNA, 17 nt, Homo sapiens
gucuuggcucacugcaa

SEQ ID NO: 1660 - RNA, 17 nt, Homo sapiens
cuuggcucacugcaacu

SEQ ID NO: 1661 - RNA, 17 nt, Homo sapiens
uggcucacugcaacuuc

SEQ ID NO: 1662 - RNA, 17 nt, Homo sapiens
cucacugcaacuucugc

SEQ ID NO: 1663 - RNA, 17 nt, Homo sapiens
acugcaacuucugccuc

SEQ ID NO: 1664 - RNA, 17 nt, Homo sapiens
gcaacuucugccucuug

SEQ ID NO: 1665 - RNA, 17 nt, Homo sapiens
acuucugccucuugggu

SEQ ID NO: 1666 - RNA, 17 nt, Homo sapiens
cuucugccucuuggguu

SEQ ID NO: 1667 - RNA, 17 nt, Homo sapiens
ucugccucuuggguuca

SEQ ID NO: 1668 - RNA, 17 nt, Homo sapiens
uuggguucaagugauuc

SEQ ID NO: 1669 - RNA, 17 nt, Homo sapiens
agugauucuccugccuc

SEQ ID NO: 1670 - RNA, 17 nt, Homo sapiens
ugauucuccugccucag

SEQ ID NO: 1671 - RNA, 17 nt, Homo sapiens
gauucuccugccucagc

SEQ ID NO: 1672 - RNA, 17 nt, Homo sapiens
ucuccugccucagccuc

SEQ ID NO: 1673 - RNA, 17 nt, Homo sapiens
cuccugccucagccucc

SEQ ID NO: 1674 - RNA, 17 nt, Homo sapiens
ccugccucagccuccug

SEQ ID NO: 1675 - RNA, 17 nt, Homo sapiens
gccucagccuccugagu

SEQ ID NO: 1676 - RNA, 17 nt, Homo sapiens
ccucagccuccugagua

SEQ ID NO: 1677 - RNA, 17 nt, Homo sapiens
ucagccuccugaguagc

SEQ ID NO: 1678 - RNA, 17 nt, Homo sapiens
cagccuccugaguagcu

SEQ ID NO: 1679 - RNA, 17 nt, Homo sapiens
ugaguagcuggauuaca

SEQ ID NO: 1680 - RNA, 17 nt, Homo sapiens
uggauuacaggcaugug

SEQ ID NO: 1681 - RNA, 17 nt, Homo sapiens
uuacaggcaugugccac

SEQ ID NO: 1682 - RNA, 17 nt, Homo sapiens
gcaugugccacccaccc

SEQ ID NO: 1683 - RNA, 17 nt, Homo sapiens
caugugccacccaccca

SEQ ID NO: 1684 - RNA, 17 nt, Homo sapiens
ugugccacccacccaac

SEQ ID NO: 1685 - RNA, 17 nt, Homo sapiens
gugccacccacccaacu

SEQ ID NO: 1686 - RNA, 17 nt, Homo sapiens
ugccacccacccaacua

SEQ ID NO: 1687 - RNA, 17 nt, Homo sapiens
ccacccacccaacuaau

SEQ ID NO: 1688 - RNA, 17 nt, Homo sapiens
cacccacccaacuaauu

SEQ ID NO: 1689 - RNA, 17 nt, Homo sapiens
acccacccaacuaauuu

SEQ ID NO: 1690 - RNA, 17 nt, Homo sapiens
cacccaacuaauuuuug

SEQ ID NO: 1691 - RNA, 17 nt, Homo sapiens
auaaagacaggguuuca

SEQ ID NO: 1692 - RNA, 17 nt, Homo sapiens
aggguuucaccauguug

SEQ ID NO: 1693 - RNA, 17 nt, Homo sapiens
gguuucaccauguuggc

SEQ ID NO: 1694 - RNA, 17 nt, Homo sapiens
guuucaccauguuggcc

SEQ ID NO: 1695 - RNA, 17 nt, Homo sapiens
auguuggccaggcuggu

SEQ ID NO: 1696 - RNA, 17 nt, Homo sapiens
uguuggccaggcugguc

SEQ ID NO: 1697 - RNA, 17 nt, Homo sapiens
ggccaggcuggucucaa

SEQ ID NO: 1698 - RNA, 17 nt, Homo sapiens
ggcuggucucaaacucc

SEQ ID NO: 1699 - RNA, 17 nt, Homo sapiens
cuggucucaaacuccug

SEQ ID NO: 1700 - RNA, 17 nt, Homo sapiens
ucucaaacuccugaccu

SEQ ID NO: 1701 - RNA, 17 nt, Homo sapiens
ucaaacuccugaccuca

SEQ ID NO: 1702 - RNA, 17 nt, Homo sapiens
caaacuccugaccucaa

SEQ ID NO: 1703 - RNA, 17 nt, Homo sapiens
cuccugaccucaaguaa

SEQ ID NO: 1704 - RNA, 17 nt, Homo sapiens
uccugaccucaaguaau

SEQ ID NO: 1705 - RNA, 17 nt, Homo sapiens
cugaccucaaguaaucc

SEQ ID NO: 1706 - RNA, 17 nt, Homo sapiens
aaguaauccaccugccu

SEQ ID NO: 1707 - RNA, 17 nt, Homo sapiens
aguaauccaccugccuc

SEQ ID NO: 1708 - RNA, 17 nt, Homo sapiens
uaauccaccugccucgg

SEQ ID NO: 1709 - RNA, 17 nt, Homo sapiens
aauccaccugccucggc

SEQ ID NO: 1710 - RNA, 17 nt, Homo sapiens
ccaccugccucggccuc

SEQ ID NO: 1711 - RNA, 17 nt, Homo sapiens
caccugccucggccucc

SEQ ID NO: 1712 - RNA, 17 nt, Homo sapiens
gccucggccucccaaag

SEQ ID NO: 1713 - RNA, 17 nt, Homo sapiens
ccucggccucccaaagu

SEQ ID NO: 1714 - RNA, 17 nt, Homo sapiens
ucggccucccaaagugc

SEQ ID NO: 1715 - RNA, 17 nt, Homo sapiens
cggccucccaaagugcu

SEQ ID NO: 1716 - RNA, 17 nt, Homo sapiens
ggccucccaaagugcug

SEQ ID NO: 1717 - RNA, 17 nt, Homo sapiens
caaagugcugggauuac

SEQ ID NO: 1718 - RNA, 17 nt, Homo sapiens
gggauuacagggaugag

SEQ ID NO: 1719 - RNA, 17 nt, Homo sapiens
ggaugagccaccgcgcc

SEQ ID NO: 1720 - RNA, 17 nt, Homo sapiens
gaugagccaccgcgccc

SEQ ID NO: 1721 - RNA, 17 nt, Homo sapiens
ugagccaccgcgcccag

SEQ ID NO: 1722 - RNA, 17 nt, Homo sapiens
caccgcgcccagccuca

SEQ ID NO: 1723 - RNA, 17 nt, Homo sapiens
accgcgcccagccucau

SEQ ID NO: 1724 - RNA, 17 nt, Homo sapiens
ccgcgcccagccucauc

SEQ ID NO: 1725 - RNA, 17 nt, Homo sapiens
cgcccagccucaucucu

SEQ ID NO: 1726 - RNA, 17 nt, Homo sapiens
gcccagccucaucucuu

SEQ ID NO: 1727 - RNA, 17 nt, Homo sapiens
ccagccucaucucuuug

SEQ ID NO: 1728 - RNA, 17 nt, Homo sapiens
gccucaucucuuuguuc

SEQ ID NO: 1729 - RNA, 17 nt, Homo sapiens
cucaucucuuuguucua

SEQ ID NO: 1730 - RNA, 17 nt, Homo sapiens
cuuuguucuaaagaugg

SEQ ID NO: 1731 - RNA, 17 nt, Homo sapiens
ggaaaaaccacccccaa

SEQ ID NO: 1732 - RNA, 17 nt, Homo sapiens
gaaaaaccacccccaaa

SEQ ID NO: 1733 - RNA, 17 nt, Homo sapiens
aaaaccacccccaaauu

SEQ ID NO: 1734 - RNA, 17 nt, Homo sapiens
aaaccacccccaaauuu

SEQ ID NO: 1735 - RNA, 17 nt, Homo sapiens
aaccacccccaaauuuu

SEQ ID NO: 1736 - RNA, 17 nt, Homo sapiens
accacccccaaauuuuc

SEQ ID NO: 1737 - RNA, 17 nt, Homo sapiens
ccacccccaaauuuucu

SEQ ID NO: 1738 - RNA, 17 nt, Homo sapiens
aaauuuucuuuuuauac

SEQ ID NO: 1739 - RNA, 17 nt, Homo sapiens
uuuuauacuauuaauga

SEQ ID NO: 1740 - RNA, 17 nt, Homo sapiens
aaugaaucaaucaauuc

SEQ ID NO: 1741 - RNA, 17 nt, Homo sapiens
aaucaaucaauucauau

SEQ ID NO: 1742 - RNA, 17 nt, Homo sapiens
aucaauucauaucuauu

SEQ ID NO: 1743 - RNA, 17 nt, Homo sapiens
uucauaucuauuuauua

SEQ ID NO: 1744 - RNA, 17 nt, Homo sapiens
uaaauuucuaccgcuuu

SEQ ID NO: 1745 - RNA, 17 nt, Homo sapiens
auuucuaccgcuuuuag

SEQ ID NO: 1746 - RNA, 17 nt, Homo sapiens
ucuaccgcuuuuaggcc

SEQ ID NO: 1747 - RNA, 17 nt, Homo sapiens
uuuuaggccaaaaaaau

SEQ ID NO: 1748 - RNA, 17 nt, Homo sapiens
uuuaggccaaaaaaaug

SEQ ID NO: 1749 - RNA, 17 nt, Homo sapiens
gaucguucucugccuca

SEQ ID NO: 1750 - RNA, 17 nt, Homo sapiens
ucguucucugccucaca

SEQ ID NO: 1751 - RNA, 17 nt, Homo sapiens
uucucugccucacauag

SEQ ID NO: 1752 - RNA, 17 nt, Homo sapiens
ucucugccucacauagc

SEQ ID NO: 1753 - RNA, 17 nt, Homo sapiens
ucugccucacauagcuu

SEQ ID NO: 1754 - RNA, 17 nt, Homo sapiens
ugccucacauagcuuac

SEQ ID NO: 1755 - RNA, 17 nt, Homo sapiens
cacauagcuuacaagcc

SEQ ID NO: 1756 - RNA, 17 nt, Homo sapiens
uagcuuacaagccagcu

SEQ ID NO: 1757 - RNA, 17 nt, Homo sapiens
uuacaagccagcuggag

SEQ ID NO: 1758 - RNA, 17 nt, Homo sapiens
uacaagccagcuggaga

SEQ ID NO: 1759 - RNA, 17 nt, Homo sapiens
aagccagcuggagaaau

SEQ ID NO: 1760 - RNA, 17 nt, Homo sapiens
uaugguacucauuaaaa

SEQ ID NO: 1761 - RNA, 17 nt, Homo sapiens
ugguacucauuaaaaaa

SEQ ID NO: 1762 - RNA, 38 nt, Artificial Sequence
  Description of Artificial Sequence:  Enzymatic Nucleic Acid
  misc_feature (31)..(31): n stands for inosine
gagcaaaccugaugaggccguuaggccgaancgccgcc

SEQ ID NO: 1763 - RNA, 38 nt, Artificial Sequence
  Description of Artificial Sequence:  Enzymatic Nucleic Acid
  misc_feature (31)..(31): n stands for inosine
aaaguaugcugaugaggccguuaggccgaancaaacug

SEQ ID NO: 1764 - RNA, 38 nt, Artificial Sequence
  Description of Artificial Sequence:  Enzymatic Nucleic Acid
  misc_feature (31)..(31): n stands for inosine
acaaaguacugaugaggccguuaggccgaanagcaaac

SEQ ID NO: 1765 - RNA, 38 nt, Artificial Sequence
  Description of Artificial Sequence:  Enzymatic Nucleic Acid
  misc_feature (31)..(31): n stands for inosine
agucacaacugaugaggccguuaggccgaanuaugagc

SEQ ID NO: 1766 - RNA, 38 nt, Artificial Sequence
  Description of Artificial Sequence:  Enzymatic Nucleic Acid
  misc_feature (31)..(31): n stands for inosine
ugaccgcacugaugaggccguuaggccgaanucacaaa

SEQ ID NO: 1767 - RNA, 38 nt, Artificial Sequence
  Description of Artificial Sequence:  Enzymatic Nucleic Acid
  misc_feature (31)..(31): n stands for inosine
ugccacugcugaugaggccguuaggccgaanaccgcaa

SEQ ID NO: 1768 - RNA, 38 nt, Artificial Sequence
  Description of Artificial Sequence:  Enzymatic Nucleic Acid
  misc_feature (31)..(31): n stands for inosine
aaugccaccugaugaggccguuaggccgaanugaccgc

SEQ ID NO: 1769 - RNA, 38 nt, Artificial Sequence
  Description of Artificial Sequence:  Enzymatic Nucleic Acid
  misc_feature (31)..(31): n stands for inosine
gagcugaacugaugaggccguuaggccgaanccacugu

SEQ ID NO: 1770 - RNA, 38 nt, Artificial Sequence
  Description of Artificial Sequence:  Enzymatic Nucleic Acid
  misc_feature (31)..(31): n stands for inosine
uguggagccugaugaggccguuaggccgaanaaugcca

SEQ ID NO: 1771 - RNA, 38 nt, Artificial Sequence
  Description of Artificial Sequence:  Enzymatic Nucleic Acid
  misc_feature (31)..(31): n stands for inosine
aaguguggcugaugaggccguuaggccgaancugaaug

SEQ ID NO: 1772 - RNA, 38 nt, Artificial Sequence
  Description of Artificial Sequence:  Enzymatic Nucleic Acid
  misc_feature (31)..(31): n stands for inosine
ccaagugucugaugaggccguuaggccgaanagcugaa

SEQ ID NO: 1773 - RNA, 38 nt, Artificial Sequence
  Description of Artificial Sequence:  Enzymatic Nucleic Acid
  misc_feature (31)..(31): n stands for inosine
accaagugcugaugaggccguuaggccgaangagcuga

SEQ ID NO: 1774 - RNA, 38 nt, Artificial Sequence
  Description of Artificial Sequence:  Enzymatic Nucleic Acid
  misc_feature (31)..(31): n stands for inosine
cuaccaagcugaugaggccguuaggccgaanuggagcu

SEQ ID NO: 1775 - RNA, 38 nt, Artificial Sequence
  Description of Artificial Sequence:  Enzymatic Nucleic Acid
  misc_feature (31)..(31): n stands for inosine
uucuaccacugaugaggccguuaggccgaanuguggag

SEQ ID NO: 1776 - RNA, 38 nt, Artificial Sequence
  Description of Artificial Sequence:  Enzymatic Nucleic Acid
  misc_feature (31)..(31): n stands for inosine
gugccugucugaugaggccguuaggccgaanuucuacc

SEQ ID NO: 1777 - RNA, 38 nt, Artificial Sequence
  Description of Artificial Sequence:  Enzymatic Nucleic Acid
  misc_feature (31)..(31): n stands for inosine
cgugccugcugaugaggccguuaggccgaanguucuac

SEQ ID NO: 1778 - RNA, 38 nt, Artificial Sequence
  Description of Artificial Sequence:  Enzymatic Nucleic Acid
  misc_feature (31)..(31): n stands for inosine
gucgugcccugaugaggccguuaggccgaanugguucu

SEQ ID NO: 1779 - RNA, 38 nt, Artificial Sequence
  Description of Artificial Sequence:  Enzymatic Nucleic Acid
  misc_feature (31)..(31): n stands for inosine
gcuugucgcugaugaggccguuaggccgaanccugugg

SEQ ID NO: 1780 - RNA, 38 nt, Artificial Sequence
  Description of Artificial Sequence:  Enzymatic Nucleic Acid
  misc_feature (31)..(31): n stands for inosine
ucuaugcucugaugaggccguuaggccgaanucgugcc

SEQ ID NO: 1781 - RNA, 38 nt, Artificial Sequence
  Description of Artificial Sequence:  Enzymatic Nucleic Acid
  misc_feature (31)..(31): n stands for inosine
uguuucuacugaugaggccguuaggccgaancuugucg

SEQ ID NO: 1782 - RNA, 38 nt, Artificial Sequence
  Description of Artificial Sequence:  Enzymatic Nucleic Acid
  misc_feature (31)..(31): n stands for inosine
guuuaggacugaugaggccguuaggccgaanuuucuau

SEQ ID NO: 1783 - RNA, 38 nt, Artificial Sequence
  Description of Artificial Sequence:  Enzymatic Nucleic Acid
  misc_feature (31)..(31): n stands for inosine
auuguuuacugaugaggccguuaggccgaanauguuuc

SEQ ID NO: 1784 - RNA, 38 nt, Artificial Sequence
  Description of Artificial Sequence:  Enzymatic Nucleic Acid
  misc_feature (31)..(31): n stands for inosine
gauuguuucugaugaggccguuaggccgaangauguuu

SEQ ID NO: 1785 - RNA, 38 nt, Artificial Sequence
  Description of Artificial Sequence:  Enzymatic Nucleic Acid
  misc_feature (31)..(31): n stands for inosine
augaagaucugaugaggccguuaggccgaanuuuagga

SEQ ID NO: 1786 - RNA, 38 nt, Artificial Sequence
  Description of Artificial Sequence:  Enzymatic Nucleic Acid
  misc_feature (31)..(31): n stands for inosine
cucgaugacugaugaggccguuaggccgaanauuguuu

SEQ ID NO: 1787 - RNA, 38 nt, Artificial Sequence
  Description of Artificial Sequence:  Enzymatic Nucleic Acid
  misc_feature (31)..(31): n stands for inosine
ugccucgacugaugaggccguuaggccgaanaagauug

SEQ ID NO: 1788 - RNA, 38 nt, Artificial Sequence
  Description of Artificial Sequence:  Enzymatic Nucleic Acid
  misc_feature (31)..(31): n stands for inosine
gaccucgacugaugaggccguuaggccgaanccucgau

SEQ ID NO: 1789 - RNA, 38 nt, Artificial Sequence
  Description of Artificial Sequence:  Enzymatic Nucleic Acid
  misc_feature (31)..(31): n stands for inosine
auugggaucugaugaggccguuaggccgaanaccucga

SEQ ID NO: 1790 - RNA, 38 nt, Artificial Sequence
  Description of Artificial Sequence:  Enzymatic Nucleic Acid
  misc_feature (31)..(31): n stands for inosine
uauugggacugaugaggccguuaggccgaangaccucg

SEQ ID NO: 1791 - RNA, 38 nt, Artificial Sequence
  Description of Artificial Sequence:  Enzymatic Nucleic Acid
  misc_feature (31)..(31): n stands for inosine
uuuuauugcugaugaggccguuaggccgaanauggacc

SEQ ID NO: 1792 - RNA, 38 nt, Artificial Sequence
  Description of Artificial Sequence:  Enzymatic Nucleic Acid
  misc_feature (31)..(31): n stands for inosine
uuuuuauucugaugaggccguuaggccgaangauggac

SEQ ID NO: 1793 - RNA, 38 nt, Artificial Sequence
  Description of Artificial Sequence:  Enzymatic Nucleic Acid
  misc_feature (31)..(31): n stands for inosine
auuuuuaucugaugaggccguuaggccgaanggaugga

SEQ ID NO: 1794 - RNA, 38 nt, Artificial Sequence
  Description of Artificial Sequence:  Enzymatic Nucleic Acid
  misc_feature (31)..(31): n stands for inosine
gggucucccugaugaggccguuaggccgaanauuuuua

SEQ ID NO: 1795 - RNA, 38 nt, Artificial Sequence
  Description of Artificial Sequence:  Enzymatic Nucleic Acid
  misc_feature (31)..(31): n stands for inosine
auagccagcugaugaggccguuaggccgaanucuccug

SEQ ID NO: 1796 - RNA, 38 nt, Artificial Sequence
  Description of Artificial Sequence:  Enzymatic Nucleic Acid
  misc_feature (31)..(31): n stands for inosine
gauagccacugaugaggccguuaggccgaangucuccu

SEQ ID NO: 1797 - RNA, 38 nt, Artificial Sequence
  Description of Artificial Sequence:  Enzymatic Nucleic Acid
  misc_feature (31)..(31): n stands for inosine
ugauagcccugaugaggccguuaggccgaanggucucc

SEQ ID NO: 1798 - RNA, 38 nt, Artificial Sequence
  Description of Artificial Sequence:  Enzymatic Nucleic Acid
  misc_feature (31)..(31): n stands for inosine
ucuaugaucugaugaggccguuaggccgaanccagggu

SEQ ID NO: 1799 - RNA, 38 nt, Artificial Sequence
  Description of Artificial Sequence:  Enzymatic Nucleic Acid
  misc_feature (31)..(31): n stands for inosine
aaggucuacugaugaggccguuaggccgaanauagcca

SEQ ID NO: 1800 - RNA, 38 nt, Artificial Sequence
  Description of Artificial Sequence:  Enzymatic Nucleic Acid
  misc_feature (31)..(31): n stands for inosine
aagacuaacugaugaggccguuaggccgaanucuauga

SEQ ID NO: 1801 - RNA, 38 nt, Artificial Sequence
  Description of Artificial Sequence:  Enzymatic Nucleic Acid
  misc_feature (31)..(31): n stands for inosine
gaagacuacugaugaggccguuaggccgaangucuaug

SEQ ID NO: 1802 - RNA, 38 nt, Artificial Sequence
  Description of Artificial Sequence:  Enzymatic Nucleic Acid
  misc_feature (31)..(31): n stands for inosine
accagcgacugaugaggccguuaggccgaanacuaagg

SEQ ID NO: 1803 - RNA, 38 nt, Artificial Sequence
  Description of Artificial Sequence:  Enzymatic Nucleic Acid
  misc_feature (31)..(31): n stands for inosine
aguauacccugaugaggccguuaggccgaancgaagac

SEQ ID NO: 1804 - RNA, 38 nt, Artificial Sequence
  Description of Artificial Sequence:  Enzymatic Nucleic Acid
  misc_feature (31)..(31): n stands for inosine
agacagcgcugaugaggccguuaggccgaanuauacca

SEQ ID NO: 1805 - RNA, 38 nt, Artificial Sequence
  Description of Artificial Sequence:  Enzymatic Nucleic Acid
  misc_feature (31)..(31): n stands for inosine
ugacagaccugaugaggccguuaggccgaancgaguau

SEQ ID NO: 1806 - RNA, 38 nt, Artificial Sequence
  Description of Artificial Sequence:  Enzymatic Nucleic Acid
  misc_feature (31)..(31): n stands for inosine
ugguugaccugaugaggccguuaggccgaanacagcga

SEQ ID NO: 1807 - RNA, 38 nt, Artificial Sequence
  Description of Artificial Sequence:  Enzymatic Nucleic Acid
  misc_feature (31)..(31): n stands for inosine
ccgcuggucugaugaggccguuaggccgaanacagaca

SEQ ID NO: 1808 - RNA, 38 nt, Artificial Sequence
  Description of Artificial Sequence:  Enzymatic Nucleic Acid
  misc_feature (31)..(31): n stands for inosine
caaccgcucugaugaggccguuaggccgaanuugacag

SEQ ID NO: 1809 - RNA, 38 nt, Artificial Sequence
  Description of Artificial Sequence:  Enzymatic Nucleic Acid
  misc_feature (31)..(31): n stands for inosine
ucaaccgccugaugaggccguuaggccgaanguugaca

SEQ ID NO: 1810 - RNA, 38 nt, Artificial Sequence
  Description of Artificial Sequence:  Enzymatic Nucleic Acid
  misc_feature (31)..(31): n stands for inosine
uuaaaaaacugaugaggccguuaggccgaanucaaccg

SEQ ID NO: 1811 - RNA, 38 nt, Artificial Sequence
  Description of Artificial Sequence:  Enzymatic Nucleic Acid
  misc_feature (31)..(31): n stands for inosine
aaaaagaacugaugaggccguuaggccgaancuuaaaa

SEQ ID NO: 1812 - RNA, 38 nt, Artificial Sequence
  Description of Artificial Sequence:  Enzymatic Nucleic Acid
  misc_feature (31)..(31): n stands for inosine
aaaaaagacugaugaggccguuaggccgaangcuuaaa

SEQ ID NO: 1813 - RNA, 38 nt, Artificial Sequence
  Description of Artificial Sequence:  Enzymatic Nucleic Acid
  misc_feature (31)..(31): n stands for inosine
gagaaaaacugaugaggccguuaggccgaanaaggcuu

SEQ ID NO: 1814 - RNA, 38 nt, Artificial Sequence
  Description of Artificial Sequence:  Enzymatic Nucleic Acid
  misc_feature (31)..(31): n stands for inosine
gguaaaagcugaugaggccguuaggccgaanaaaaaag

SEQ ID NO: 1815 - RNA, 38 nt, Artificial Sequence
  Description of Artificial Sequence:  Enzymatic Nucleic Acid
  misc_feature (31)..(31): n stands for inosine
cugguaaacugaugaggccguuaggccgaanagaaaaa

SEQ ID NO: 1816 - RNA, 38 nt, Artificial Sequence
  Description of Artificial Sequence:  Enzymatic Nucleic Acid
  misc_feature (31)..(31): n stands for inosine
cagaaacucugaugaggccguuaggccgaanuaaaaga

SEQ ID NO: 1817 - RNA, 38 nt, Artificial Sequence
  Description of Artificial Sequence:  Enzymatic Nucleic Acid
  misc_feature (31)..(31): n stands for inosine
ccagaaaccugaugaggccguuaggccgaanguaaaag

SEQ ID NO: 1818 - RNA, 38 nt, Artificial Sequence
  Description of Artificial Sequence:  Enzymatic Nucleic Acid
  misc_feature (31)..(31): n stands for inosine
uuugcucccugaugaggccguuaggccgaanaaacugg

SEQ ID NO: 1819 - RNA, 38 nt, Artificial Sequence
  Description of Artificial Sequence:  Enzymatic Nucleic Acid
  misc_feature (31)..(31): n stands for inosine
acugaauucugaugaggccguuaggccgaancuccaga

SEQ ID NO: 1820 - RNA, 38 nt, Artificial Sequence
  Description of Artificial Sequence:  Enzymatic Nucleic Acid
  misc_feature (31)..(31): n stands for inosine
aggcaaaccugaugaggccguuaggccgaanaauuugc

SEQ ID NO: 1821 - RNA, 38 nt, Artificial Sequence
  Description of Artificial Sequence:  Enzymatic Nucleic Acid
  misc_feature (31)..(31): n stands for inosine
uccaggaacugaugaggccguuaggccgaancaaacug

SEQ ID NO: 1822 - RNA, 38 nt, Artificial Sequence
  Description of Artificial Sequence:  Enzymatic Nucleic Acid
  misc_feature (31)..(31): n stands for inosine
auccaggacugaugaggccguuaggccgaangcaaacu

SEQ ID NO: 1823 - RNA, 38 nt, Artificial Sequence
  Description of Artificial Sequence:  Enzymatic Nucleic Acid
  misc_feature (31)..(31): n stands for inosine
caaauccacugaugaggccguuaggccgaanaaggcaa

SEQ ID NO: 1824 - RNA, 38 nt, Artificial Sequence
  Description of Artificial Sequence:  Enzymatic Nucleic Acid
  misc_feature (31)..(31): n stands for inosine
acaaaucccugaugaggccguuaggccgaangaaggca

SEQ ID NO: 1825 - RNA, 38 nt, Artificial Sequence
  Description of Artificial Sequence:  Enzymatic Nucleic Acid
  misc_feature (31)..(31): n stands for inosine
aguuuugacugaugaggccguuaggccgaanucauuac

SEQ ID NO: 1826 - RNA, 38 nt, Artificial Sequence
  Description of Artificial Sequence:  Enzymatic Nucleic Acid
  misc_feature (31)..(31): n stands for inosine
aaguuuugcugaugaggccguuaggccgaangucauua

SEQ ID NO: 1827 - RNA, 38 nt, Artificial Sequence
  Description of Artificial Sequence:  Enzymatic Nucleic Acid
  misc_feature (31)..(31): n stands for inosine
uaaaguuucugaugaggccguuaggccgaanaggucau

SEQ ID NO: 1828 - RNA, 38 nt, Artificial Sequence
  Description of Artificial Sequence:  Enzymatic Nucleic Acid
  misc_feature (31)..(31): n stands for inosine
acugcuaacugaugaggccguuaggccgaanuuuugag

SEQ ID NO: 1829 - RNA, 38 nt, Artificial Sequence
  Description of Artificial Sequence:  Enzymatic Nucleic Acid
  misc_feature (31)..(31): n stands for inosine
ggaagaaccugaugaggccguuaggccgaancuaaagu

SEQ ID NO: 1830 - RNA, 38 nt, Artificial Sequence
  Description of Artificial Sequence:  Enzymatic Nucleic Acid
  misc_feature (31)..(31): n stands for inosine
cagauggacugaugaggccguuaggccgaanaacugcu

SEQ ID NO: 1831 - RNA, 38 nt, Artificial Sequence
  Description of Artificial Sequence:  Enzymatic Nucleic Acid
  misc_feature (31)..(31): n stands for inosine
agucagaucugaugaggccguuaggccgaanaagaacu

SEQ ID NO: 1832 - RNA, 38 nt, Artificial Sequence
  Description of Artificial Sequence:  Enzymatic Nucleic Acid
  misc_feature (31)..(31): n stands for inosine
gagucagacugaugaggccguuaggccgaangaagaac

SEQ ID NO: 1833 - RNA, 38 nt, Artificial Sequence
  Description of Artificial Sequence:  Enzymatic Nucleic Acid
  misc_feature (31)..(31): n stands for inosine
ccugaguccugaugaggccguuaggccgaanauggaag

SEQ ID NO: 1834 - RNA, 38 nt, Artificial Sequence
  Description of Artificial Sequence:  Enzymatic Nucleic Acid
  misc_feature (31)..(31): n stands for inosine
caaaccugcugaugaggccguuaggccgaanucagaug

SEQ ID NO: 1835 - RNA, 38 nt, Artificial Sequence
  Description of Artificial Sequence:  Enzymatic Nucleic Acid
  misc_feature (31)..(31): n stands for inosine
agcaaacccugaugaggccguuaggccgaanagucaga

SEQ ID NO: 1836 - RNA, 38 nt, Artificial Sequence
  Description of Artificial Sequence:  Enzymatic Nucleic Acid
  misc_feature (31)..(31): n stands for inosine
gccagagacugaugaggccguuaggccgaancaaaccu

SEQ ID NO: 1837 - RNA, 38 nt, Artificial Sequence
  Description of Artificial Sequence:  Enzymatic Nucleic Acid
  misc_feature (31)..(31): n stands for inosine
accgccagcugaugaggccguuaggccgaanaagcaaa

SEQ ID NO: 1838 - RNA, 38 nt, Artificial Sequence
  Description of Artificial Sequence:  Enzymatic Nucleic Acid
  misc_feature (31)..(31): n stands for inosine
agaccgcccugaugaggccguuaggccgaanagaagca

SEQ ID NO: 1839 - RNA, 38 nt, Artificial Sequence
  Description of Artificial Sequence:  Enzymatic Nucleic Acid
  misc_feature (31)..(31): n stands for inosine
gauucugacugaugaggccguuaggccgaanaccgcca

SEQ ID NO: 1840 - RNA, 38 nt, Artificial Sequence
  Description of Artificial Sequence:  Enzymatic Nucleic Acid
  misc_feature (31)..(31): n stands for inosine
guugauuccugaugaggccguuaggccgaanaagaccg

SEQ ID NO: 1841 - RNA, 38 nt, Artificial Sequence
  Description of Artificial Sequence:  Enzymatic Nucleic Acid
  misc_feature (31)..(31): n stands for inosine
guggaugucugaugaggccguuaggccgaanauucuga

SEQ ID NO: 1842 - RNA, 38 nt, Artificial Sequence
  Description of Artificial Sequence:  Enzymatic Nucleic Acid
  misc_feature (31)..(31): n stands for inosine
aguguggacugaugaggccguuaggccgaanuugauuc

SEQ ID NO: 1843 - RNA, 38 nt, Artificial Sequence
  Description of Artificial Sequence:  Enzymatic Nucleic Acid
  misc_feature (31)..(31): n stands for inosine
ggaagugucugaugaggccguuaggccgaanauguuga

SEQ ID NO: 1844 - RNA, 38 nt, Artificial Sequence
  Description of Artificial Sequence:  Enzymatic Nucleic Acid
  misc_feature (31)..(31): n stands for inosine
cggaagugcugaugaggccguuaggccgaangauguug

SEQ ID NO: 1845 - RNA, 38 nt, Artificial Sequence
  Description of Artificial Sequence:  Enzymatic Nucleic Acid
  misc_feature (31)..(31): n stands for inosine
cacggaagcugaugaggccguuaggccgaanuggaugu

SEQ ID NO: 1846 - RNA, 38 nt, Artificial Sequence
  Description of Artificial Sequence:  Enzymatic Nucleic Acid
  misc_feature (31)..(31): n stands for inosine
aucacggacugaugaggccguuaggccgaanuguggau

SEQ ID NO: 1847 - RNA, 38 nt, Artificial Sequence
  Description of Artificial Sequence:  Enzymatic Nucleic Acid
  misc_feature (31)..(31): n stands for inosine
auaaucaccugaugaggccguuaggccgaanaagugug

SEQ ID NO: 1848 - RNA, 38 nt, Artificial Sequence
  Description of Artificial Sequence:  Enzymatic Nucleic Acid
  misc_feature (31)..(31): n stands for inosine
augcacgccugaugaggccguuaggccgaanauaauca

SEQ ID NO: 1849 - RNA, 38 nt, Artificial Sequence
  Description of Artificial Sequence:  Enzymatic Nucleic Acid
  misc_feature (31)..(31): n stands for inosine
guccaaaacugaugaggccguuaggccgaancacgcag

SEQ ID NO: 1850 - RNA, 38 nt, Artificial Sequence
  Description of Artificial Sequence:  Enzymatic Nucleic Acid
  misc_feature (31)..(31): n stands for inosine
ggaagcuucugaugaggccguuaggccgaanuccaaaa

SEQ ID NO: 1851 - RNA, 38 nt, Artificial Sequence
  Description of Artificial Sequence:  Enzymatic Nucleic Acid
  misc_feature (31)..(31): n stands for inosine
ugguuggacugaugaggccguuaggccgaancuuuguc

SEQ ID NO: 1852 - RNA, 38 nt, Artificial Sequence
  Description of Artificial Sequence:  Enzymatic Nucleic Acid
  misc_feature (31)..(31): n stands for inosine
uccugguucugaugaggccguuaggccgaanaagcuuu

SEQ ID NO: 1853 - RNA, 38 nt, Artificial Sequence
  Description of Artificial Sequence:  Enzymatic Nucleic Acid
  misc_feature (31)..(31): n stands for inosine
auccuggucugaugaggccguuaggccgaangaagcuu

SEQ ID NO: 1854 - RNA, 38 nt, Artificial Sequence
  Description of Artificial Sequence:  Enzymatic Nucleic Acid
  misc_feature (31)..(31): n stands for inosine
cguauccucugaugaggccguuaggccgaanuuggaag

SEQ ID NO: 1855 - RNA, 38 nt, Artificial Sequence
  Description of Artificial Sequence:  Enzymatic Nucleic Acid
  misc_feature (31)..(31): n stands for inosine
ccguaucccugaugaggccguuaggccgaanguuggaa

SEQ ID NO: 1856 - RNA, 38 nt, Artificial Sequence
  Description of Artificial Sequence:  Enzymatic Nucleic Acid
  misc_feature (31)..(31): n stands for inosine
agaucacccugaugaggccguuaggccgaanccauuuc

SEQ ID NO: 1857 - RNA, 38 nt, Artificial Sequence
  Description of Artificial Sequence:  Enzymatic Nucleic Acid
  misc_feature (31)..(31): n stands for inosine
cugcugaacugaugaggccguuaggccgaanaucacca

SEQ ID NO: 1858 - RNA, 38 nt, Artificial Sequence
  Description of Artificial Sequence:  Enzymatic Nucleic Acid
  misc_feature (31)..(31): n stands for inosine
aaaccugccugaugaggccguuaggccgaanaaagauc

SEQ ID NO: 1859 - RNA, 38 nt, Artificial Sequence
  Description of Artificial Sequence:  Enzymatic Nucleic Acid
  misc_feature (31)..(31): n stands for inosine
aagaaacccugaugaggccguuaggccgaancugaaag

SEQ ID NO: 1860 - RNA, 38 nt, Artificial Sequence
  Description of Artificial Sequence:  Enzymatic Nucleic Acid
  misc_feature (31)..(31): n stands for inosine
cuccaugacugaugaggccguuaggccgaanaaaccug

SEQ ID NO: 1861 - RNA, 38 nt, Artificial Sequence
  Description of Artificial Sequence:  Enzymatic Nucleic Acid
  misc_feature (31)..(31): n stands for inosine
uuccuccacugaugaggccguuaggccgaanaagaaac

SEQ ID NO: 1862 - RNA, 38 nt, Artificial Sequence
  Description of Artificial Sequence:  Enzymatic Nucleic Acid
  misc_feature (31)..(31): n stands for inosine
auguauuacugaugaggccguuaggccgaanuuccucc

SEQ ID NO: 1863 - RNA, 38 nt, Artificial Sequence
  Description of Artificial Sequence:  Enzymatic Nucleic Acid
  misc_feature (31)..(31): n stands for inosine
ugacgguacugaugaggccguuaggccgaanuauuaag

SEQ ID NO: 1864 - RNA, 38 nt, Artificial Sequence
  Description of Artificial Sequence:  Enzymatic Nucleic Acid
  misc_feature (31)..(31): n stands for inosine
cuucugaccugaugaggccguuaggccgaanuauguau

SEQ ID NO: 1865 - RNA, 38 nt, Artificial Sequence
  Description of Artificial Sequence:  Enzymatic Nucleic Acid
  misc_feature (31)..(31): n stands for inosine
ccugcuuccugaugaggccguuaggccgaanacgguau

SEQ ID NO: 1866 - RNA, 38 nt, Artificial Sequence
  Description of Artificial Sequence:  Enzymatic Nucleic Acid
  misc_feature (31)..(31): n stands for inosine
cuacuccccugaugaggccguuaggccgaancuucuga

SEQ ID NO: 1867 - RNA, 38 nt, Artificial Sequence
  Description of Artificial Sequence:  Enzymatic Nucleic Acid
  misc_feature (31)..(31): n stands for inosine
gauauuuacugaugaggccguuaggccgaanuacuacu

SEQ ID NO: 1868 - RNA, 38 nt, Artificial Sequence
  Description of Artificial Sequence:  Enzymatic Nucleic Acid
  misc_feature (31)..(31): n stands for inosine
gcaguucucugaugaggccguuaggccgaanauauuua

SEQ ID NO: 1869 - RNA, 38 nt, Artificial Sequence
  Description of Artificial Sequence:  Enzymatic Nucleic Acid
  misc_feature (31)..(31): n stands for inosine
aauuaggccugaugaggccguuaggccgaanuucuuga

SEQ ID NO: 1870 - RNA, 38 nt, Artificial Sequence
  Description of Artificial Sequence:  Enzymatic Nucleic Acid
  misc_feature (31)..(31): n stands for inosine
cugaauuacugaugaggccguuaggccgaancaguucu

SEQ ID NO: 1871 - RNA, 38 nt, Artificial Sequence
  Description of Artificial Sequence:  Enzymatic Nucleic Acid
  misc_feature (31)..(31): n stands for inosine
ccugaauucugaugaggccguuaggccgaangcaguuc

SEQ ID NO: 1872 - RNA, 38 nt, Artificial Sequence
  Description of Artificial Sequence:  Enzymatic Nucleic Acid
  misc_feature (31)..(31): n stands for inosine
ggaggucccugaugaggccguuaggccgaanaauuagg

SEQ ID NO: 1873 - RNA, 38 nt, Artificial Sequence
  Description of Artificial Sequence:  Enzymatic Nucleic Acid
  misc_feature (31)..(31): n stands for inosine
cauguggacugaugaggccguuaggccgaanuccugaa

SEQ ID NO: 1874 - RNA, 38 nt, Artificial Sequence
  Description of Artificial Sequence:  Enzymatic Nucleic Acid
  misc_feature (31)..(31): n stands for inosine
ucauguggcugaugaggccguuaggccgaanguccuga

SEQ ID NO: 1875 - RNA, 38 nt, Artificial Sequence
  Description of Artificial Sequence:  Enzymatic Nucleic Acid
  misc_feature (31)..(31): n stands for inosine
uaucaugucugaugaggccguuaggccgaanagguccu

SEQ ID NO: 1876 - RNA, 38 nt, Artificial Sequence
  Description of Artificial Sequence:  Enzymatic Nucleic Acid
  misc_feature (31)..(31): n stands for inosine
cuaucaugcugaugaggccguuaggccgaangaggucc

SEQ ID NO: 1877 - RNA, 38 nt, Artificial Sequence
  Description of Artificial Sequence:  Enzymatic Nucleic Acid
  misc_feature (31)..(31): n stands for inosine
uccuaucacugaugaggccguuaggccgaanuggaggu

SEQ ID NO: 1878 - RNA, 38 nt, Artificial Sequence
  Description of Artificial Sequence:  Enzymatic Nucleic Acid
  misc_feature (31)..(31): n stands for inosine
acuugaaacugaugaggccguuaggccgaanuaaaccu

SEQ ID NO: 1879 - RNA, 38 nt, Artificial Sequence
  Description of Artificial Sequence:  Enzymatic Nucleic Acid
  misc_feature (31)..(31): n stands for inosine
uuauaacucugaugaggccguuaggccgaanaaaugua

SEQ ID NO: 1880 - RNA, 38 nt, Artificial Sequence
  Description of Artificial Sequence:  Enzymatic Nucleic Acid
  misc_feature (31)..(31): n stands for inosine
caccuucucugaugaggccguuaggccgaanaaauucu

SEQ ID NO: 1881 - RNA, 38 nt, Artificial Sequence
  Description of Artificial Sequence:  Enzymatic Nucleic Acid
  misc_feature (31)..(31): n stands for inosine
ucaccuuccugaugaggccguuaggccgaangaaauuc

SEQ ID NO: 1882 - RNA, 38 nt, Artificial Sequence
  Description of Artificial Sequence:  Enzymatic Nucleic Acid
  misc_feature (31)..(31): n stands for inosine
uccuucuucugaugaggccguuaggccgaanaucuacc

SEQ ID NO: 1883 - RNA, 38 nt, Artificial Sequence
  Description of Artificial Sequence:  Enzymatic Nucleic Acid
  misc_feature (31)..(31): n stands for inosine
gcauuuuucugaugaggccguuaggccgaancuuccuu

SEQ ID NO: 1884 - RNA, 38 nt, Artificial Sequence
  Description of Artificial Sequence:  Enzymatic Nucleic Acid
  misc_feature (31)..(31): n stands for inosine
uuggcugccugaugaggccguuaggccgaancauuuuu

SEQ ID NO: 1885 - RNA, 38 nt, Artificial Sequence
  Description of Artificial Sequence:  Enzymatic Nucleic Acid
  misc_feature (31)..(31): n stands for inosine
aauuuggccugaugaggccguuaggccgaancggcauu

SEQ ID NO: 1886 - RNA, 38 nt, Artificial Sequence
  Description of Artificial Sequence:  Enzymatic Nucleic Acid
  misc_feature (31)..(31): n stands for inosine
gcuaauuucugaugaggccguuaggccgaancugcggc

SEQ ID NO: 1887 - RNA, 38 nt, Artificial Sequence
  Description of Artificial Sequence:  Enzymatic Nucleic Acid
  misc_feature (31)..(31): n stands for inosine
agcuaauucugaugaggccguuaggccgaangcugcgg

SEQ ID NO: 1888 - RNA, 38 nt, Artificial Sequence
  Description of Artificial Sequence:  Enzymatic Nucleic Acid
  misc_feature (31)..(31): n stands for inosine
aucucaaccugaugaggccguuaggccgaancuaauuu

SEQ ID NO: 1889 - RNA, 38 nt, Artificial Sequence
  Description of Artificial Sequence:  Enzymatic Nucleic Acid
  misc_feature (31)..(31): n stands for inosine
ccuuauuacugaugaggccguuaggccgaanuaucuca

SEQ ID NO: 1890 - RNA, 38 nt, Artificial Sequence
  Description of Artificial Sequence:  Enzymatic Nucleic Acid
  misc_feature (31)..(31): n stands for inosine
ggacuaaccugaugaggccguuaggccgaanccuucuu

SEQ ID NO: 1891 - RNA, 38 nt, Artificial Sequence
  Description of Artificial Sequence:  Enzymatic Nucleic Acid
  misc_feature (31)..(31): n stands for inosine
auaauaaacugaugaggccguuaggccgaanacuaacu

SEQ ID NO: 1892 - RNA, 38 nt, Artificial Sequence
  Description of Artificial Sequence:  Enzymatic Nucleic Acid
  misc_feature (31)..(31): n stands for inosine
aauaauaacugaugaggccguuaggccgaangacuaac

SEQ ID NO: 1893 - RNA, 38 nt, Artificial Sequence
  Description of Artificial Sequence:  Enzymatic Nucleic Acid
  misc_feature (31)..(31): n stands for inosine
uucguugucugaugaggccguuaggccgaanucaauaa

SEQ ID NO: 1894 - RNA, 38 nt, Artificial Sequence
  Description of Artificial Sequence:  Enzymatic Nucleic Acid
  misc_feature (31)..(31): n stands for inosine
gaauucgucugaugaggccguuaggccgaanuugucaa

SEQ ID NO: 1895 - RNA, 38 nt, Artificial Sequence
  Description of Artificial Sequence:  Enzymatic Nucleic Acid
  misc_feature (31)..(31): n stands for inosine
ccuucugacugaugaggccguuaggccgaanaauucgu

SEQ ID NO: 1896 - RNA, 38 nt, Artificial Sequence
  Description of Artificial Sequence:  Enzymatic Nucleic Acid
  misc_feature (31)..(31): n stands for inosine
aauccuuccugaugaggccguuaggccgaanaagaauu

SEQ ID NO: 1897 - RNA, 38 nt, Artificial Sequence
  Description of Artificial Sequence:  Enzymatic Nucleic Acid
  misc_feature (31)..(31): n stands for inosine
uuccccaucugaugaggccguuaggccgaanauaaucc

SEQ ID NO: 1898 - RNA, 38 nt, Artificial Sequence
  Description of Artificial Sequence:  Enzymatic Nucleic Acid
  misc_feature (31)..(31): n stands for inosine
auuccccacugaugaggccguuaggccgaangauaauc

SEQ ID NO: 1899 - RNA, 38 nt, Artificial Sequence
  Description of Artificial Sequence:  Enzymatic Nucleic Acid
  misc_feature (31)..(31): n stands for inosine
aaggccuacugaugaggccguuaggccgaanuaauucc

SEQ ID NO: 1900 - RNA, 38 nt, Artificial Sequence
  Description of Artificial Sequence:  Enzymatic Nucleic Acid
  misc_feature (31)..(31): n stands for inosine
auugauaacugaugaggccguuaggccgaanccuaugu

SEQ ID NO: 1901 - RNA, 38 nt, Artificial Sequence
  Description of Artificial Sequence:  Enzymatic Nucleic Acid
  misc_feature (31)..(31): n stands for inosine
uauugauacugaugaggccguuaggccgaangccuaug

SEQ ID NO: 1902 - RNA, 38 nt, Artificial Sequence
  Description of Artificial Sequence:  Enzymatic Nucleic Acid
  misc_feature (31)..(31): n stands for inosine
aauucuaucugaugaggccguuaggccgaanauaaggc

SEQ ID NO: 1903 - RNA, 38 nt, Artificial Sequence
  Description of Artificial Sequence:  Enzymatic Nucleic Acid
  misc_feature (31)..(31): n stands for inosine
uucuucugcugaugaggccguuaggccgaancaauucu

SEQ ID NO: 1904 - RNA, 38 nt, Artificial Sequence
  Description of Artificial Sequence:  Enzymatic Nucleic Acid
  misc_feature (31)..(31): n stands for inosine
uuucuucucugaugaggccguuaggccgaangcaauuc

SEQ ID NO: 1905 - RNA, 38 nt, Artificial Sequence
  Description of Artificial Sequence:  Enzymatic Nucleic Acid
  misc_feature (31)..(31): n stands for inosine
uuuucuuccugaugaggccguuaggccgaanggcaauu

SEQ ID NO: 1906 - RNA, 38 nt, Artificial Sequence
  Description of Artificial Sequence:  Enzymatic Nucleic Acid
  misc_feature (31)..(31): n stands for inosine
uuacaguucugaugaggccguuaggccgaanucuuuuc

SEQ ID NO: 1907 - RNA, 38 nt, Artificial Sequence
  Description of Artificial Sequence:  Enzymatic Nucleic Acid
  misc_feature (31)..(31): n stands for inosine
uaauuuaccugaugaggccguuaggccgaanuuagucu

SEQ ID NO: 1908 - RNA, 38 nt, Artificial Sequence
  Description of Artificial Sequence:  Enzymatic Nucleic Acid
  misc_feature (31)..(31): n stands for inosine
augcacaccugaugaggccguuaggccgaanuucauaa

SEQ ID NO: 1909 - RNA, 38 nt, Artificial Sequence
  Description of Artificial Sequence:  Enzymatic Nucleic Acid
  misc_feature (31)..(31): n stands for inosine
acccccgacugaugaggccguuaggccgaancacacug

SEQ ID NO: 1910 - RNA, 38 nt, Artificial Sequence
  Description of Artificial Sequence:  Enzymatic Nucleic Acid
  misc_feature (31)..(31): n stands for inosine
cuggcccacugaugaggccguuaggccgaancaccccc

SEQ ID NO: 1911 - RNA, 38 nt, Artificial Sequence
  Description of Artificial Sequence:  Enzymatic Nucleic Acid
  misc_feature (31)..(31): n stands for inosine
auccuucucugaugaggccguuaggccgaancccaugc

SEQ ID NO: 1912 - RNA, 38 nt, Artificial Sequence
  Description of Artificial Sequence:  Enzymatic Nucleic Acid
  misc_feature (31)..(31): n stands for inosine
aauccuuccugaugaggccguuaggccgaangcccaug

SEQ ID NO: 1913 - RNA, 38 nt, Artificial Sequence
  Description of Artificial Sequence:  Enzymatic Nucleic Acid
  misc_feature (31)..(31): n stands for inosine
auuuauaacugaugaggccguuaggccgaanaaauccu

SEQ ID NO: 1914 - RNA, 38 nt, Artificial Sequence
  Description of Artificial Sequence:  Enzymatic Nucleic Acid
  misc_feature (31)..(31): n stands for inosine
ucccauuucugaugaggccguuaggccgaancauuuau

SEQ ID NO: 1915 - RNA, 38 nt, Artificial Sequence
  Description of Artificial Sequence:  Enzymatic Nucleic Acid
  misc_feature (31)..(31): n stands for inosine
auucuuuccugaugaggccguuaggccgaanucccauu

SEQ ID NO: 1916 - RNA, 38 nt, Artificial Sequence
  Description of Artificial Sequence:  Enzymatic Nucleic Acid
  misc_feature (31)..(31): n stands for inosine
guagaacccugaugaggccguuaggccgaanuaccaau

SEQ ID NO: 1917 - RNA, 38 nt, Artificial Sequence
  Description of Artificial Sequence:  Enzymatic Nucleic Acid
  misc_feature (31)..(31): n stands for inosine
uguuuagucugaugaggccguuaggccgaanaaccugu

SEQ ID NO: 1918 - RNA, 38 nt, Artificial Sequence
  Description of Artificial Sequence:  Enzymatic Nucleic Acid
  misc_feature (31)..(31): n stands for inosine
uccuguuucugaugaggccguuaggccgaanuagaacc

SEQ ID NO: 1919 - RNA, 38 nt, Artificial Sequence
  Description of Artificial Sequence:  Enzymatic Nucleic Acid
  misc_feature (31)..(31): n stands for inosine
uugcuucccugaugaggccguuaggccgaanuuuagua

SEQ ID NO: 1920 - RNA, 38 nt, Artificial Sequence
  Description of Artificial Sequence:  Enzymatic Nucleic Acid
  misc_feature (31)..(31): n stands for inosine
aauuguuucugaugaggccguuaggccgaancuuccug

SEQ ID NO: 1921 - RNA, 38 nt, Artificial Sequence
  Description of Artificial Sequence:  Enzymatic Nucleic Acid
  misc_feature (31)..(31): n stands for inosine
cggccaaucugaugaggccguuaggccgaanuuuugcu

SEQ ID NO: 1922 - RNA, 38 nt, Artificial Sequence
  Description of Artificial Sequence:  Enzymatic Nucleic Acid
  misc_feature (31)..(31): n stands for inosine
aguuuagccugaugaggccguuaggccgaanccaauug

SEQ ID NO: 1923 - RNA, 38 nt, Artificial Sequence
  Description of Artificial Sequence:  Enzymatic Nucleic Acid
  misc_feature (31)..(31): n stands for inosine
gcaaguuucugaugaggccguuaggccgaancggccaa

SEQ ID NO: 1924 - RNA, 38 nt, Artificial Sequence
  Description of Artificial Sequence:  Enzymatic Nucleic Acid
  misc_feature (31)..(31): n stands for inosine
gauaugcacugaugaggccguuaggccgaanuuuagcg

SEQ ID NO: 1925 - RNA, 38 nt, Artificial Sequence
  Description of Artificial Sequence:  Enzymatic Nucleic Acid
  misc_feature (31)..(31): n stands for inosine
ugaagauacugaugaggccguuaggccgaancaaguuu

SEQ ID NO: 1926 - RNA, 38 nt, Artificial Sequence
  Description of Artificial Sequence:  Enzymatic Nucleic Acid
  misc_feature (31)..(31): n stands for inosine
auaucugacugaugaggccguuaggccgaanauaugca

SEQ ID NO: 1927 - RNA, 38 nt, Artificial Sequence
  Description of Artificial Sequence:  Enzymatic Nucleic Acid
  misc_feature (31)..(31): n stands for inosine
auaauauccugaugaggccguuaggccgaanaagauau

SEQ ID NO: 1928 - RNA, 38 nt, Artificial Sequence
  Description of Artificial Sequence:  Enzymatic Nucleic Acid
  misc_feature (31)..(31): n stands for inosine
guuucuuccugaugaggccguuaggccgaanauaauau

SEQ ID NO: 1929 - RNA, 38 nt, Artificial Sequence
  Description of Artificial Sequence:  Enzymatic Nucleic Acid
  misc_feature (31)..(31): n stands for inosine
uucacugacugaugaggccguuaggccgaanuuucuuc

SEQ ID NO: 1930 - RNA, 38 nt, Artificial Sequence
  Description of Artificial Sequence:  Enzymatic Nucleic Acid
  misc_feature (31)..(31): n stands for inosine
uuucacugcugaugaggccguuaggccgaanguuucuu

SEQ ID NO: 1931 - RNA, 38 nt, Artificial Sequence
  Description of Artificial Sequence:  Enzymatic Nucleic Acid
  misc_feature (31)..(31): n stands for inosine
gauuucaccugaugaggccguuaggccgaanagguuuc

SEQ ID NO: 1932 - RNA, 38 nt, Artificial Sequence
  Description of Artificial Sequence:  Enzymatic Nucleic Acid
  misc_feature (31)..(31): n stands for inosine
agguaguccugaugaggccguuaggccgaanauuucac

SEQ ID NO: 1933 - RNA, 38 nt, Artificial Sequence
  Description of Artificial Sequence:  Enzymatic Nucleic Acid
  misc_feature (31)..(31): n stands for inosine
ggacaggucugaugaggccguuaggccgaanucagauu

SEQ ID NO: 1934 - RNA, 38 nt, Artificial Sequence
  Description of Artificial Sequence:  Enzymatic Nucleic Acid
  misc_feature (31)..(31): n stands for inosine
agaggacacugaugaggccguuaggccgaanuagucag

SEQ ID NO: 1935 - RNA, 38 nt, Artificial Sequence
  Description of Artificial Sequence:  Enzymatic Nucleic Acid
  misc_feature (31)..(31): n stands for inosine
cagaggaccugaugaggccguuaggccgaanguaguca

SEQ ID NO: 1936 - RNA, 38 nt, Artificial Sequence
  Description of Artificial Sequence:  Enzymatic Nucleic Acid
  misc_feature (31)..(31): n stands for inosine
gaaccagacugaugaggccguuaggccgaanacaggua

SEQ ID NO: 1937 - RNA, 38 nt, Artificial Sequence
  Description of Artificial Sequence:  Enzymatic Nucleic Acid
  misc_feature (31)..(31): n stands for inosine
agaaccagcugaugaggccguuaggccgaangacaggu

SEQ ID NO: 1938 - RNA, 38 nt, Artificial Sequence
  Description of Artificial Sequence:  Enzymatic Nucleic Acid
  misc_feature (31)..(31): n stands for inosine
aaagaacccugaugaggccguuaggccgaanaggacag

SEQ ID NO: 1939 - RNA, 38 nt, Artificial Sequence
  Description of Artificial Sequence:  Enzymatic Nucleic Acid
  misc_feature (31)..(31): n stands for inosine
guagcaaacugaugaggccguuaggccgaanaaccaga

SEQ ID NO: 1940 - RNA, 38 nt, Artificial Sequence
  Description of Artificial Sequence:  Enzymatic Nucleic Acid
  misc_feature (31)..(31): n stands for inosine
cacguagucugaugaggccguuaggccgaancaaaaga

SEQ ID NO: 1941 - RNA, 38 nt, Artificial Sequence
  Description of Artificial Sequence:  Enzymatic Nucleic Acid
  misc_feature (31)..(31): n stands for inosine
ucacacgucugaugaggccguuaggccgaanuagcaaa

SEQ ID NO: 1942 - RNA, 38 nt, Artificial Sequence
  Description of Artificial Sequence:  Enzymatic Nucleic Acid
  misc_feature (31)..(31): n stands for inosine
uugcuuugcugaugaggccguuaggccgaanacucaca

SEQ ID NO: 1943 - RNA, 38 nt, Artificial Sequence
  Description of Artificial Sequence:  Enzymatic Nucleic Acid
  misc_feature (31)..(31): n stands for inosine
guugcuuucugaugaggccguuaggccgaangacucac

SEQ ID NO: 1944 - RNA, 38 nt, Artificial Sequence
  Description of Artificial Sequence:  Enzymatic Nucleic Acid
  misc_feature (31)..(31): n stands for inosine
aguugcuucugaugaggccguuaggccgaanggacuca

SEQ ID NO: 1945 - RNA, 38 nt, Artificial Sequence
  Description of Artificial Sequence:  Enzymatic Nucleic Acid
  misc_feature (31)..(31): n stands for inosine
uaaagagucugaugaggccguuaggccgaancuuuggg

SEQ ID NO: 1946 - RNA, 38 nt, Artificial Sequence
  Description of Artificial Sequence:  Enzymatic Nucleic Acid
  misc_feature (31)..(31): n stands for inosine
cacuaaagcugaugaggccguuaggccgaanuugcuuu

SEQ ID NO: 1947 - RNA, 38 nt, Artificial Sequence
  Description of Artificial Sequence:  Enzymatic Nucleic Acid
  misc_feature (31)..(31): n stands for inosine
gucacuaacugaugaggccguuaggccgaanaguugcu

SEQ ID NO: 1948 - RNA, 38 nt, Artificial Sequence
  Description of Artificial Sequence:  Enzymatic Nucleic Acid
  misc_feature (31)..(31): n stands for inosine
agugugcucugaugaggccguuaggccgaanucacuaa

SEQ ID NO: 1949 - RNA, 38 nt, Artificial Sequence
  Description of Artificial Sequence:  Enzymatic Nucleic Acid
  misc_feature (31)..(31): n stands for inosine
gagugugccugaugaggccguuaggccgaangucacua

SEQ ID NO: 1950 - RNA, 38 nt, Artificial Sequence
  Description of Artificial Sequence:  Enzymatic Nucleic Acid
  misc_feature (31)..(31): n stands for inosine
agcgagugcugaugaggccguuaggccgaancugguca

SEQ ID NO: 1951 - RNA, 38 nt, Artificial Sequence
  Description of Artificial Sequence:  Enzymatic Nucleic Acid
  misc_feature (31)..(31): n stands for inosine
gaagcgagcugaugaggccguuaggccgaanugcuggu

SEQ ID NO: 1952 - RNA, 38 nt, Artificial Sequence
  Description of Artificial Sequence:  Enzymatic Nucleic Acid
  misc_feature (31)..(31): n stands for inosine
cagaagcgcugaugaggccguuaggccgaanugugcug

SEQ ID NO: 1953 - RNA, 38 nt, Artificial Sequence
  Description of Artificial Sequence:  Enzymatic Nucleic Acid
  misc_feature (31)..(31): n stands for inosine
gauucagacugaugaggccguuaggccgaancgagugu

SEQ ID NO: 1954 - RNA, 38 nt, Artificial Sequence
  Description of Artificial Sequence:  Enzymatic Nucleic Acid
  misc_feature (31)..(31): n stands for inosine
gaugauuccugaugaggccguuaggccgaanaagcgag

SEQ ID NO: 1955 - RNA, 38 nt, Artificial Sequence
  Description of Artificial Sequence:  Enzymatic Nucleic Acid
  misc_feature (31)..(31): n stands for inosine
ucagaugacugaugaggccguuaggccgaanauucaga

SEQ ID NO: 1956 - RNA, 38 nt, Artificial Sequence
  Description of Artificial Sequence:  Enzymatic Nucleic Acid
  misc_feature (31)..(31): n stands for inosine
ccuucagacugaugaggccguuaggccgaanaugauuc

SEQ ID NO: 1957 - RNA, 38 nt, Artificial Sequence
  Description of Artificial Sequence:  Enzymatic Nucleic Acid
  misc_feature (31)..(31): n stands for inosine
ucaccuuccugaugaggccguuaggccgaanaugauga

SEQ ID NO: 1958 - RNA, 38 nt, Artificial Sequence
  Description of Artificial Sequence:  Enzymatic Nucleic Acid
  misc_feature (31)..(31): n stands for inosine
ugcugagacugaugaggccguuaggccgaanucaccuu

SEQ ID NO: 1959 - RNA, 38 nt, Artificial Sequence
  Description of Artificial Sequence:  Enzymatic Nucleic Acid
  misc_feature (31)..(31): n stands for inosine
aucugcugcugaugaggccguuaggccgaanaagucac

SEQ ID NO: 1960 - RNA, 38 nt, Artificial Sequence
  Description of Artificial Sequence:  Enzymatic Nucleic Acid
  misc_feature (31)..(31): n stands for inosine
guaucugccugaugaggccguuaggccgaanagaaguc

SEQ ID NO: 1961 - RNA, 38 nt, Artificial Sequence
  Description of Artificial Sequence:  Enzymatic Nucleic Acid
  misc_feature (31)..(31): n stands for inosine
gauguauccugaugaggccguuaggccgaancugagaa

SEQ ID NO: 1962 - RNA, 38 nt, Artificial Sequence
  Description of Artificial Sequence:  Enzymatic Nucleic Acid
  misc_feature (31)..(31): n stands for inosine
aucucugacugaugaggccguuaggccgaanuaucugc

SEQ ID NO: 1963 - RNA, 38 nt, Artificial Sequence
  Description of Artificial Sequence:  Enzymatic Nucleic Acid
  misc_feature (31)..(31): n stands for inosine
uuuaucuccugaugaggccguuaggccgaanauguauc

SEQ ID NO: 1964 - RNA, 38 nt, Artificial Sequence
  Description of Artificial Sequence:  Enzymatic Nucleic Acid
  misc_feature (31)..(31): n stands for inosine
ucacuguucugaugaggccguuaggccgaanaauuuau

SEQ ID NO: 1965 - RNA, 38 nt, Artificial Sequence
  Description of Artificial Sequence:  Enzymatic Nucleic Acid
  misc_feature (31)..(31): n stands for inosine
acugucaccugaugaggccguuaggccgaanuuagaau

SEQ ID NO: 1966 - RNA, 38 nt, Artificial Sequence
  Description of Artificial Sequence:  Enzymatic Nucleic Acid
  misc_feature (31)..(31): n stands for inosine
guuuaaaccugaugaggccguuaggccgaanucacugu

SEQ ID NO: 1967 - RNA, 38 nt, Artificial Sequence
  Description of Artificial Sequence:  Enzymatic Nucleic Acid
  misc_feature (31)..(31): n stands for inosine
cgaagaaccugaugaggccguuaggccgaanuuuaaac

SEQ ID NO: 1968 - RNA, 38 nt, Artificial Sequence
  Description of Artificial Sequence:  Enzymatic Nucleic Acid
  misc_feature (31)..(31): n stands for inosine
agcaacgacugaugaggccguuaggccgaanaacuguu

SEQ ID NO: 1969 - RNA, 38 nt, Artificial Sequence
  Description of Artificial Sequence:  Enzymatic Nucleic Acid
  misc_feature (31)..(31): n stands for inosine
cauucauacugaugaggccguuaggccgaancaacgaa

SEQ ID NO: 1970 - RNA, 38 nt, Artificial Sequence
  Description of Artificial Sequence:  Enzymatic Nucleic Acid
  misc_feature (31)..(31): n stands for inosine
uauuucugcugaugaggccguuaggccgaanaccauuc

SEQ ID NO: 1971 - RNA, 38 nt, Artificial Sequence
  Description of Artificial Sequence:  Enzymatic Nucleic Acid
  misc_feature (31)..(31): n stands for inosine
auuauuuccugaugaggccguuaggccgaanagaccau

SEQ ID NO: 1972 - RNA, 38 nt, Artificial Sequence
  Description of Artificial Sequence:  Enzymatic Nucleic Acid
  misc_feature (31)..(31): n stands for inosine
ccuuccuucugaugaggccguuaggccgaanauuauuu

SEQ ID NO: 1973 - RNA, 38 nt, Artificial Sequence
  Description of Artificial Sequence:  Enzymatic Nucleic Acid
  misc_feature (31)..(31): n stands for inosine
gaucuuuucugaugaggccguuaggccgaanccuuccu

SEQ ID NO: 1974 - RNA, 38 nt, Artificial Sequence
  Description of Artificial Sequence:  Enzymatic Nucleic Acid
  misc_feature (31)..(31): n stands for inosine
ggugccaacugaugaggccguuaggccgaanaucuuuu

SEQ ID NO: 1975 - RNA, 38 nt, Artificial Sequence
  Description of Artificial Sequence:  Enzymatic Nucleic Acid
  misc_feature (31)..(31): n stands for inosine
aaucugggcugaugaggccguuaggccgaanccaaaga

SEQ ID NO: 1976 - RNA, 38 nt, Artificial Sequence
  Description of Artificial Sequence:  Enzymatic Nucleic Acid
  misc_feature (31)..(31): n stands for inosine
caaaucugcugaugaggccguuaggccgaanugccaaa

SEQ ID NO: 1977 - RNA, 38 nt, Artificial Sequence
  Description of Artificial Sequence:  Enzymatic Nucleic Acid
  misc_feature (31)..(31): n stands for inosine
ucaaaucucugaugaggccguuaggccgaangugccaa

SEQ ID NO: 1978 - RNA, 38 nt, Artificial Sequence
  Description of Artificial Sequence:  Enzymatic Nucleic Acid
  misc_feature (31)..(31): n stands for inosine
gucaaauccugaugaggccguuaggccgaanggugcca

SEQ ID NO: 1979 - RNA, 38 nt, Artificial Sequence
  Description of Artificial Sequence:  Enzymatic Nucleic Acid
  misc_feature (31)..(31): n stands for inosine
gucaggaacugaugaggccguuaggccgaanucaaauc

SEQ ID NO: 1980 - RNA, 38 nt, Artificial Sequence
  Description of Artificial Sequence:  Enzymatic Nucleic Acid
  misc_feature (31)..(31): n stands for inosine
ugucaggacugaugaggccguuaggccgaangucaaau

SEQ ID NO: 1981 - RNA, 38 nt, Artificial Sequence
  Description of Artificial Sequence:  Enzymatic Nucleic Acid
  misc_feature (31)..(31): n stands for inosine
ucaugucacugaugaggccguuaggccgaanaagguca

SEQ ID NO: 1982 - RNA, 38 nt, Artificial Sequence
  Description of Artificial Sequence:  Enzymatic Nucleic Acid
  misc_feature (31)..(31): n stands for inosine
uucauguccugaugaggccguuaggccgaangaagguc

SEQ ID NO: 1983 - RNA, 38 nt, Artificial Sequence
  Description of Artificial Sequence:  Enzymatic Nucleic Acid
  misc_feature (31)..(31): n stands for inosine
uucuuucacugaugaggccguuaggccgaanucaggaa

SEQ ID NO: 1984 - RNA, 38 nt, Artificial Sequence
  Description of Artificial Sequence:  Enzymatic Nucleic Acid
  misc_feature (31)..(31): n stands for inosine
guauacuucugaugaggccguuaggccgaanuuucuuu

SEQ ID NO: 1985 - RNA, 38 nt, Artificial Sequence
  Description of Artificial Sequence:  Enzymatic Nucleic Acid
  misc_feature (31)..(31): n stands for inosine
uuguccaccugaugaggccguuaggccgaanuauacuu

SEQ ID NO: 1986 - RNA, 38 nt, Artificial Sequence
  Description of Artificial Sequence:  Enzymatic Nucleic Acid
  misc_feature (31)..(31): n stands for inosine
aaaccucucugaugaggccguuaggccgaanuccacag

SEQ ID NO: 1987 - RNA, 38 nt, Artificial Sequence
  Description of Artificial Sequence:  Enzymatic Nucleic Acid
  misc_feature (31)..(31): n stands for inosine
aaaauccacugaugaggccguuaggccgaanccaaacc

SEQ ID NO: 1988 - RNA, 38 nt, Artificial Sequence
  Description of Artificial Sequence:  Enzymatic Nucleic Acid
  misc_feature (31)..(31): n stands for inosine
uccaccugcugaugaggccguuaggccgaanccaauua

SEQ ID NO: 1989 - RNA, 38 nt, Artificial Sequence
  Description of Artificial Sequence:  Enzymatic Nucleic Acid
  misc_feature (31)..(31): n stands for inosine
aauccacccugaugaggccguuaggccgaanagccaau

SEQ ID NO: 1990 - RNA, 38 nt, Artificial Sequence
  Description of Artificial Sequence:  Enzymatic Nucleic Acid
  misc_feature (31)..(31): n stands for inosine
gaaaacuucugaugaggccguuaggccgaanccaaauc

SEQ ID NO: 1991 - RNA, 38 nt, Artificial Sequence
  Description of Artificial Sequence:  Enzymatic Nucleic Acid
  misc_feature (31)..(31): n stands for inosine
ugaaaacucugaugaggccguuaggccgaangccaaau

SEQ ID NO: 1992 - RNA, 38 nt, Artificial Sequence
  Description of Artificial Sequence:  Enzymatic Nucleic Acid
  misc_feature (31)..(31): n stands for inosine
uuuugcuucugaugaggccguuaggccgaanaaaacuu

SEQ ID NO: 1993 - RNA, 38 nt, Artificial Sequence
  Description of Artificial Sequence:  Enzymatic Nucleic Acid
  misc_feature (31)..(31): n stands for inosine
cuguguuucugaugaggccguuaggccgaancuuugaa

SEQ ID NO: 1994 - RNA, 38 nt, Artificial Sequence
  Description of Artificial Sequence:  Enzymatic Nucleic Acid
  misc_feature (31)..(31): n stands for inosine
caauucugcugaugaggccguuaggccgaanuuuugcu

SEQ ID NO: 1995 - RNA, 38 nt, Artificial Sequence
  Description of Artificial Sequence:  Enzymatic Nucleic Acid
  misc_feature (31)..(31): n stands for inosine
gucaauuccugaugaggccguuaggccgaanuguuuug

SEQ ID NO: 1996 - RNA, 38 nt, Artificial Sequence
  Description of Artificial Sequence:  Enzymatic Nucleic Acid
  misc_feature (31)..(31): n stands for inosine
auaacguacugaugaggccguuaggccgaanucuuucc

SEQ ID NO: 1997 - RNA, 38 nt, Artificial Sequence
  Description of Artificial Sequence:  Enzymatic Nucleic Acid
  misc_feature (31)..(31): n stands for inosine
uuugccaacugaugaggccguuaggccgaancuuuuac

SEQ ID NO: 1998 - RNA, 38 nt, Artificial Sequence
  Description of Artificial Sequence:  Enzymatic Nucleic Acid
  misc_feature (31)..(31): n stands for inosine
ucaaguuucugaugaggccguuaggccgaanccaaugc

SEQ ID NO: 1999 - RNA, 38 nt, Artificial Sequence
  Description of Artificial Sequence:  Enzymatic Nucleic Acid
  misc_feature (31)..(31): n stands for inosine
caugaucacugaugaggccguuaggccgaanuuuugcc

SEQ ID NO: 2000 - RNA, 38 nt, Artificial Sequence
  Description of Artificial Sequence:  Enzymatic Nucleic Acid
  misc_feature (31)..(31): n stands for inosine
uauuuacacugaugaggccguuaggccgaanaucaagu

SEQ ID NO: 2001 - RNA, 38 nt, Artificial Sequence
  Description of Artificial Sequence:  Enzymatic Nucleic Acid
  misc_feature (31)..(31): n stands for inosine
cauuguagcugaugaggccguuaggccgaanaacaaua

SEQ ID NO: 2002 - RNA, 38 nt, Artificial Sequence
  Description of Artificial Sequence:  Enzymatic Nucleic Acid
  misc_feature (31)..(31): n stands for inosine
gccauugucugaugaggccguuaggccgaanugaacaa

SEQ ID NO: 2003 - RNA, 38 nt, Artificial Sequence
  Description of Artificial Sequence:  Enzymatic Nucleic Acid
  misc_feature (31)..(31): n stands for inosine
acagccaucugaugaggccguuaggccgaanuagugaa

SEQ ID NO: 2004 - RNA, 38 nt, Artificial Sequence
  Description of Artificial Sequence:  Enzymatic Nucleic Acid
  misc_feature (31)..(31): n stands for inosine
aucccaaccugaugaggccguuaggccgaanccauugu

SEQ ID NO: 2005 - RNA, 38 nt, Artificial Sequence
  Description of Artificial Sequence:  Enzymatic Nucleic Acid
  misc_feature (31)..(31): n stands for inosine
uggucucacugaugaggccguuaggccgaanaucauaa

SEQ ID NO: 2006 - RNA, 38 nt, Artificial Sequence
  Description of Artificial Sequence:  Enzymatic Nucleic Acid
  misc_feature (31)..(31): n stands for inosine
cuggucuccugaugaggccguuaggccgaangaucaua

SEQ ID NO: 2007 - RNA, 38 nt, Artificial Sequence
  Description of Artificial Sequence:  Enzymatic Nucleic Acid
  misc_feature (31)..(31): n stands for inosine
ucaucacucugaugaggccguuaggccgaanucucagg

SEQ ID NO: 2008 - RNA, 38 nt, Artificial Sequence
  Description of Artificial Sequence:  Enzymatic Nucleic Acid
  misc_feature (31)..(31): n stands for inosine
aucaucaccugaugaggccguuaggccgaangucucag

SEQ ID NO: 2009 - RNA, 38 nt, Artificial Sequence
  Description of Artificial Sequence:  Enzymatic Nucleic Acid
  misc_feature (31)..(31): n stands for inosine
cucucaagcugaugaggccguuaggccgaanaaucauc

SEQ ID NO: 2010 - RNA, 38 nt, Artificial Sequence
  Description of Artificial Sequence:  Enzymatic Nucleic Acid
  misc_feature (31)..(31): n stands for inosine
ugcucucacugaugaggccguuaggccgaanagaauca

SEQ ID NO: 2011 - RNA, 38 nt, Artificial Sequence
  Description of Artificial Sequence:  Enzymatic Nucleic Acid
  misc_feature (31)..(31): n stands for inosine
auaaucaccugaugaggccguuaggccgaancucucaa

SEQ ID NO: 2012 - RNA, 38 nt, Artificial Sequence
  Description of Artificial Sequence:  Enzymatic Nucleic Acid
  misc_feature (31)..(31): n stands for inosine
uguucucacugaugaggccguuaggccgaanaucauaa

SEQ ID NO: 2013 - RNA, 38 nt, Artificial Sequence
  Description of Artificial Sequence:  Enzymatic Nucleic Acid
  misc_feature (31)..(31): n stands for inosine
cuguucuccugaugaggccguuaggccgaangaucaua

SEQ ID NO: 2014 - RNA, 38 nt, Artificial Sequence
  Description of Artificial Sequence:  Enzymatic Nucleic Acid
  misc_feature (31)..(31): n stands for inosine
auuuuugccugaugaggccguuaggccgaanuucucag

SEQ ID NO: 2015 - RNA, 38 nt, Artificial Sequence
  Description of Artificial Sequence:  Enzymatic Nucleic Acid
  misc_feature (31)..(31): n stands for inosine
acuauuuucugaugaggccguuaggccgaancuguucu

SEQ ID NO: 2016 - RNA, 38 nt, Artificial Sequence
  Description of Artificial Sequence:  Enzymatic Nucleic Acid
  misc_feature (31)..(31): n stands for inosine
uuugaccucugaugaggccguuaggccgaanaacuauu

SEQ ID NO: 2017 - RNA, 38 nt, Artificial Sequence
  Description of Artificial Sequence:  Enzymatic Nucleic Acid
  misc_feature (31)..(31): n stands for inosine
uuagucuucugaugaggccguuaggccgaanaccuuga

SEQ ID NO: 2018 - RNA, 38 nt, Artificial Sequence
  Description of Artificial Sequence:  Enzymatic Nucleic Acid
  misc_feature (31)..(31): n stands for inosine
aggcacuucugaugaggccguuaggccgaanucuuuga

SEQ ID NO: 2019 - RNA, 38 nt, Artificial Sequence
  Description of Artificial Sequence:  Enzymatic Nucleic Acid
  misc_feature (31)..(31): n stands for inosine
gaugaaaacugaugaggccguuaggccgaancacuuag

SEQ ID NO: 2020 - RNA, 38 nt, Artificial Sequence
  Description of Artificial Sequence:  Enzymatic Nucleic Acid
  misc_feature (31)..(31): n stands for inosine
ggaugaaacugaugaggccguuaggccgaangcacuua

SEQ ID NO: 2021 - RNA, 38 nt, Artificial Sequence
  Description of Artificial Sequence:  Enzymatic Nucleic Acid
  misc_feature (31)..(31): n stands for inosine
cauuuggacugaugaggccguuaggccgaanaaaaggc

SEQ ID NO: 2022 - RNA, 38 nt, Artificial Sequence
  Description of Artificial Sequence:  Enzymatic Nucleic Acid
  misc_feature (31)..(31): n stands for inosine
uuccauuucugaugaggccguuaggccgaanaugaaaa

SEQ ID NO: 2023 - RNA, 38 nt, Artificial Sequence
  Description of Artificial Sequence:  Enzymatic Nucleic Acid
  misc_feature (31)..(31): n stands for inosine
auuccauucugaugaggccguuaggccgaangaugaaa

SEQ ID NO: 2024 - RNA, 38 nt, Artificial Sequence
  Description of Artificial Sequence:  Enzymatic Nucleic Acid
  misc_feature (31)..(31): n stands for inosine
uuuaucaccugaugaggccguuaggccgaanaauucca

SEQ ID NO: 2025 - RNA, 38 nt, Artificial Sequence
  Description of Artificial Sequence:  Enzymatic Nucleic Acid
  misc_feature (31)..(31): n stands for inosine
uguuccaacugaugaggccguuaggccgaanucccuuu

SEQ ID NO: 2026 - RNA, 38 nt, Artificial Sequence
  Description of Artificial Sequence:  Enzymatic Nucleic Acid
  misc_feature (31)..(31): n stands for inosine
uuguuccacugaugaggccguuaggccgaangucccuu

SEQ ID NO: 2027 - RNA, 38 nt, Artificial Sequence
  Description of Artificial Sequence:  Enzymatic Nucleic Acid
  misc_feature (31)..(31): n stands for inosine
caauccaucugaugaggccguuaggccgaanuuccaag

SEQ ID NO: 2028 - RNA, 38 nt, Artificial Sequence
  Description of Artificial Sequence:  Enzymatic Nucleic Acid
  misc_feature (31)..(31): n stands for inosine
cuuugucucugaugaggccguuaggccgaanuuucucg

SEQ ID NO: 2029 - RNA, 38 nt, Artificial Sequence
  Description of Artificial Sequence:  Enzymatic Nucleic Acid
  misc_feature (31)..(31): n stands for inosine
caaaacuucugaugaggccguuaggccgaanucuaguu

SEQ ID NO: 2030 - RNA, 38 nt, Artificial Sequence
  Description of Artificial Sequence:  Enzymatic Nucleic Acid
  misc_feature (31)..(31): n stands for inosine
aguuccaacugaugaggccguuaggccgaanccaaaac

SEQ ID NO: 2031 - RNA, 38 nt, Artificial Sequence
  Description of Artificial Sequence:  Enzymatic Nucleic Acid
  misc_feature (31)..(31): n stands for inosine
guucaaagcugaugaggccguuaggccgaanuuccaaa

SEQ ID NO: 2032 - RNA, 38 nt, Artificial Sequence
  Description of Artificial Sequence:  Enzymatic Nucleic Acid
  misc_feature (31)..(31): n stands for inosine
uuguucaacugaugaggccguuaggccgaanaguucca

SEQ ID NO: 2033 - RNA, 38 nt, Artificial Sequence
  Description of Artificial Sequence:  Enzymatic Nucleic Acid
  misc_feature (31)..(31): n stands for inosine
uuguuauucugaugaggccguuaggccgaanuucaaag

SEQ ID NO: 2034 - RNA, 38 nt, Artificial Sequence
  Description of Artificial Sequence:  Enzymatic Nucleic Acid
  misc_feature (31)..(31): n stands for inosine
accccuuucugaugaggccguuaggccgaanuuauuug

SEQ ID NO: 2035 - RNA, 38 nt, Artificial Sequence
  Description of Artificial Sequence:  Enzymatic Nucleic Acid
  misc_feature (31)..(31): n stands for inosine
uuuuugaacugaugaggccguuaggccgaanuauauaa

SEQ ID NO: 2036 - RNA, 38 nt, Artificial Sequence
  Description of Artificial Sequence:  Enzymatic Nucleic Acid
  misc_feature (31)..(31): n stands for inosine
aauuuuuucugaugaggccguuaggccgaanaauguau

SEQ ID NO: 2037 - RNA, 38 nt, Artificial Sequence
  Description of Artificial Sequence:  Enzymatic Nucleic Acid
  misc_feature (31)..(31): n stands for inosine
gaucucuacugaugaggccguuaggccgaanaauuaau

SEQ ID NO: 2038 - RNA, 38 nt, Artificial Sequence
  Description of Artificial Sequence:  Enzymatic Nucleic Acid
  misc_feature (31)..(31): n stands for inosine
uuggcuuacugaugaggccguuaggccgaanaucucua

SEQ ID NO: 2039 - RNA, 38 nt, Artificial Sequence
  Description of Artificial Sequence:  Enzymatic Nucleic Acid
  misc_feature (31)..(31): n stands for inosine
uauuacuucugaugaggccguuaggccgaancuuaaga

SEQ ID NO: 2040 - RNA, 38 nt, Artificial Sequence
  Description of Artificial Sequence:  Enzymatic Nucleic Acid
  misc_feature (31)..(31): n stands for inosine
auauuacucugaugaggccguuaggccgaangcuuaag

SEQ ID NO: 2041 - RNA, 38 nt, Artificial Sequence
  Description of Artificial Sequence:  Enzymatic Nucleic Acid
  misc_feature (31)..(31): n stands for inosine
aucuacuacugaugaggccguuaggccgaanaauauau

SEQ ID NO: 2042 - RNA, 38 nt, Artificial Sequence
  Description of Artificial Sequence:  Enzymatic Nucleic Acid
  misc_feature (31)..(31): n stands for inosine
acuuguuucugaugaggccguuaggccgaanuaucuac

SEQ ID NO: 2043 - RNA, 38 nt, Artificial Sequence
  Description of Artificial Sequence:  Enzymatic Nucleic Acid
  misc_feature (31)..(31): n stands for inosine
ucuuuacucugaugaggccguuaggccgaanuuuugua

SEQ ID NO: 2044 - RNA, 38 nt, Artificial Sequence
  Description of Artificial Sequence:  Enzymatic Nucleic Acid
  misc_feature (31)..(31): n stands for inosine
aaguccaacugaugaggccguuaggccgaanucuccaa

SEQ ID NO: 2045 - RNA, 38 nt, Artificial Sequence
  Description of Artificial Sequence:  Enzymatic Nucleic Acid
  misc_feature (31)..(31): n stands for inosine
auguuacacugaugaggccguuaggccgaanuccaaag

SEQ ID NO: 2046 - RNA, 38 nt, Artificial Sequence
  Description of Artificial Sequence:  Enzymatic Nucleic Acid
  misc_feature (31)..(31): n stands for inosine
uucagagacugaugaggccguuaggccgaanuuacaag

SEQ ID NO: 2047 - RNA, 38 nt, Artificial Sequence
  Description of Artificial Sequence:  Enzymatic Nucleic Acid
  misc_feature (31)..(31): n stands for inosine
uuuuucagcugaugaggccguuaggccgaanauguuac

SEQ ID NO: 2048 - RNA, 38 nt, Artificial Sequence
  Description of Artificial Sequence:  Enzymatic Nucleic Acid
  misc_feature (31)..(31): n stands for inosine
cauuuuuccugaugaggccguuaggccgaanagauguu

SEQ ID NO: 2049 - RNA, 38 nt, Artificial Sequence
  Description of Artificial Sequence:  Enzymatic Nucleic Acid
  misc_feature (31)..(31): n stands for inosine
uuacuccucugaugaggccguuaggccgaanuucgcuu

SEQ ID NO: 2050 - RNA, 38 nt, Artificial Sequence
  Description of Artificial Sequence:  Enzymatic Nucleic Acid
  misc_feature (31)..(31): n stands for inosine
uaucgcaacugaugaggccguuaggccgaanuucccuu

SEQ ID NO: 2051 - RNA, 38 nt, Artificial Sequence
  Description of Artificial Sequence:  Enzymatic Nucleic Acid
  misc_feature (31)..(31): n stands for inosine
ugggcucacugaugaggccguuaggccgaanuaucgca

SEQ ID NO: 2052 - RNA, 38 nt, Artificial Sequence
  Description of Artificial Sequence:  Enzymatic Nucleic Acid
  misc_feature (31)..(31): n stands for inosine
cuguucugcugaugaggccguuaggccgaancucaugu

SEQ ID NO: 2053 - RNA, 38 nt, Artificial Sequence
  Description of Artificial Sequence:  Enzymatic Nucleic Acid
  misc_feature (31)..(31): n stands for inosine
ucuguucucugaugaggccguuaggccgaangcucaug

SEQ ID NO: 2054 - RNA, 38 nt, Artificial Sequence
  Description of Artificial Sequence:  Enzymatic Nucleic Acid
  misc_feature (31)..(31): n stands for inosine
aucuguuccugaugaggccguuaggccgaanggcucau

SEQ ID NO: 2055 - RNA, 38 nt, Artificial Sequence
  Description of Artificial Sequence:  Enzymatic Nucleic Acid
  misc_feature (31)..(31): n stands for inosine
aagaaauccugaugaggccguuaggccgaanuucuggg

SEQ ID NO: 2056 - RNA, 38 nt, Artificial Sequence
  Description of Artificial Sequence:  Enzymatic Nucleic Acid
  misc_feature (31)..(31): n stands for inosine
ucuugcgacugaugaggccguuaggccgaanaaaucug

SEQ ID NO: 2057 - RNA, 38 nt, Artificial Sequence
  Description of Artificial Sequence:  Enzymatic Nucleic Acid
  misc_feature (31)..(31): n stands for inosine
cauagucucugaugaggccguuaggccgaancgaagaa

SEQ ID NO: 2058 - RNA, 38 nt, Artificial Sequence
  Description of Artificial Sequence:  Enzymatic Nucleic Acid
  misc_feature (31)..(31): n stands for inosine
cuuuccaucugaugaggccguuaggccgaanucuugcg

SEQ ID NO: 2059 - RNA, 38 nt, Artificial Sequence
  Description of Artificial Sequence:  Enzymatic Nucleic Acid
  misc_feature (31)..(31): n stands for inosine
agcguagacugaugaggccguuaggccgaanuccacuu

SEQ ID NO: 2060 - RNA, 38 nt, Artificial Sequence
  Description of Artificial Sequence:  Enzymatic Nucleic Acid
  misc_feature (31)..(31): n stands for inosine
aagcguagcugaugaggccguuaggccgaanguccacu

SEQ ID NO: 2061 - RNA, 38 nt, Artificial Sequence
  Description of Artificial Sequence:  Enzymatic Nucleic Acid
  misc_feature (31)..(31): n stands for inosine
caaagcgucugaugaggccguuaggccgaanaggucca

SEQ ID NO: 2062 - RNA, 38 nt, Artificial Sequence
  Description of Artificial Sequence:  Enzymatic Nucleic Acid
  misc_feature (31)..(31): n stands for inosine
agccccaacugaugaggccguuaggccgaancguagag

SEQ ID NO: 2063 - RNA, 38 nt, Artificial Sequence
  Description of Artificial Sequence:  Enzymatic Nucleic Acid
  misc_feature (31)..(31): n stands for inosine
caagaauucugaugaggccguuaggccgaanccccaaa

SEQ ID NO: 2064 - RNA, 38 nt, Artificial Sequence
  Description of Artificial Sequence:  Enzymatic Nucleic Acid
  misc_feature (31)..(31): n stands for inosine
guucagcacugaugaggccguuaggccgaanaauuagc

SEQ ID NO: 2065 - RNA, 38 nt, Artificial Sequence
  Description of Artificial Sequence:  Enzymatic Nucleic Acid
  misc_feature (31)..(31): n stands for inosine
agaaguuccugaugaggccguuaggccgaancaagaau

SEQ ID NO: 2066 - RNA, 38 nt, Artificial Sequence
  Description of Artificial Sequence:  Enzymatic Nucleic Acid
  misc_feature (31)..(31): n stands for inosine
caugaagacugaugaggccguuaggccgaanuucagca

SEQ ID NO: 2067 - RNA, 38 nt, Artificial Sequence
  Description of Artificial Sequence:  Enzymatic Nucleic Acid
  misc_feature (31)..(31): n stands for inosine
auacaugacugaugaggccguuaggccgaanaaguuca

SEQ ID NO: 2068 - RNA, 38 nt, Artificial Sequence
  Description of Artificial Sequence:  Enzymatic Nucleic Acid
  misc_feature (31)..(31): n stands for inosine
cacauacacugaugaggccguuaggccgaanaagaagu

SEQ ID NO: 2069 - RNA, 38 nt, Artificial Sequence
  Description of Artificial Sequence:  Enzymatic Nucleic Acid
  misc_feature (31)..(31): n stands for inosine
aaaagcagcugaugaggccguuaggccgaanucacaua

SEQ ID NO: 2070 - RNA, 38 nt, Artificial Sequence
  Description of Artificial Sequence:  Enzymatic Nucleic Acid
  misc_feature (31)..(31): n stands for inosine
ucaaaagccugaugaggccguuaggccgaanugucaca

SEQ ID NO: 2071 - RNA, 38 nt, Artificial Sequence
  Description of Artificial Sequence:  Enzymatic Nucleic Acid
  misc_feature (31)..(31): n stands for inosine
guuucaaacugaugaggccguuaggccgaancaguguc

SEQ ID NO: 2072 - RNA, 38 nt, Artificial Sequence
  Description of Artificial Sequence:  Enzymatic Nucleic Acid
  misc_feature (31)..(31): n stands for inosine
aacuuugacugaugaggccguuaggccgaanuuucaaa

SEQ ID NO: 2073 - RNA, 38 nt, Artificial Sequence
  Description of Artificial Sequence:  Enzymatic Nucleic Acid
  misc_feature (31)..(31): n stands for inosine
aaaaacuucugaugaggccguuaggccgaanauguuuc

SEQ ID NO: 2074 - RNA, 38 nt, Artificial Sequence
  Description of Artificial Sequence:  Enzymatic Nucleic Acid
  misc_feature (31)..(31): n stands for inosine
uaggucugcugaugaggccguuaggccgaanaaaaacu

SEQ ID NO: 2075 - RNA, 38 nt, Artificial Sequence
  Description of Artificial Sequence:  Enzymatic Nucleic Acid
  misc_feature (31)..(31): n stands for inosine
cguagguccugaugaggccguuaggccgaanugaaaaa

SEQ ID NO: 2076 - RNA, 38 nt, Artificial Sequence
  Description of Artificial Sequence:  Enzymatic Nucleic Acid
  misc_feature (31)..(31): n stands for inosine
aucccguacugaugaggccguuaggccgaanucuguga

SEQ ID NO: 2077 - RNA, 38 nt, Artificial Sequence
  Description of Artificial Sequence:  Enzymatic Nucleic Acid
  misc_feature (31)..(31): n stands for inosine
caucccgucugaugaggccguuaggccgaangucugug

SEQ ID NO: 2078 - RNA, 38 nt, Artificial Sequence
  Description of Artificial Sequence:  Enzymatic Nucleic Acid
  misc_feature (31)..(31): n stands for inosine
ugagaugacugaugaggccguuaggccgaanccauccc

SEQ ID NO: 2079 - RNA, 38 nt, Artificial Sequence
  Description of Artificial Sequence:  Enzymatic Nucleic Acid
  misc_feature (31)..(31): n stands for inosine
aucugagacugaugaggccguuaggccgaanaugccau

SEQ ID NO: 2080 - RNA, 38 nt, Artificial Sequence
  Description of Artificial Sequence:  Enzymatic Nucleic Acid
  misc_feature (31)..(31): n stands for inosine
uauaucugcugaugaggccguuaggccgaanaugaugc

SEQ ID NO: 2081 - RNA, 38 nt, Artificial Sequence
  Description of Artificial Sequence:  Enzymatic Nucleic Acid
  misc_feature (31)..(31): n stands for inosine
aauauauccugaugaggccguuaggccgaanagaugau

SEQ ID NO: 2082 - RNA, 38 nt, Artificial Sequence
  Description of Artificial Sequence:  Enzymatic Nucleic Acid
  misc_feature (31)..(31): n stands for inosine
uguagaagcugaugaggccguuaggccgaanuuuuuuc

SEQ ID NO: 2083 - RNA, 38 nt, Artificial Sequence
  Description of Artificial Sequence:  Enzymatic Nucleic Acid
  misc_feature (31)..(31): n stands for inosine
ucuguagacugaugaggccguuaggccgaanaguuuuu

SEQ ID NO: 2084 - RNA, 38 nt, Artificial Sequence
  Description of Artificial Sequence:  Enzymatic Nucleic Acid
  misc_feature (31)..(31): n stands for inosine
auuucugucugaugaggccguuaggccgaanaagaguu

SEQ ID NO: 2085 - RNA, 38 nt, Artificial Sequence
  Description of Artificial Sequence:  Enzymatic Nucleic Acid
  misc_feature (31)..(31): n stands for inosine
guaauuuccugaugaggccguuaggccgaanuagaaga

SEQ ID NO: 2086 - RNA, 38 nt, Artificial Sequence
  Description of Artificial Sequence:  Enzymatic Nucleic Acid
  misc_feature (31)..(31): n stands for inosine
ucuuugagcugaugaggccguuaggccgaanuaauuuc

SEQ ID NO: 2087 - RNA, 38 nt, Artificial Sequence
  Description of Artificial Sequence:  Enzymatic Nucleic Acid
  misc_feature (31)..(31): n stands for inosine
uuucuuugcugaugaggccguuaggccgaanaguaauu

SEQ ID NO: 2088 - RNA, 38 nt, Artificial Sequence
  Description of Artificial Sequence:  Enzymatic Nucleic Acid
  misc_feature (31)..(31): n stands for inosine
gguuucuucugaugaggccguuaggccgaanagaguaa

SEQ ID NO: 2089 - RNA, 38 nt, Artificial Sequence
  Description of Artificial Sequence:  Enzymatic Nucleic Acid
  misc_feature (31)..(31): n stands for inosine
gauccucacugaugaggccguuaggccgaanuuucuuu

SEQ ID NO: 2090 - RNA, 38 nt, Artificial Sequence
  Description of Artificial Sequence:  Enzymatic Nucleic Acid
  misc_feature (31)..(31): n stands for inosine
cgauccuccugaugaggccguuaggccgaanguuucuu

SEQ ID NO: 2091 - RNA, 38 nt, Artificial Sequence
  Description of Artificial Sequence:  Enzymatic Nucleic Acid
  misc_feature (31)..(31): n stands for inosine
auguguuacugaugaggccguuaggccgaanucgaucc

SEQ ID NO: 2092 - RNA, 38 nt, Artificial Sequence
  Description of Artificial Sequence:  Enzymatic Nucleic Acid
  misc_feature (31)..(31): n stands for inosine
gauguguucugaugaggccguuaggccgaangucgauc

SEQ ID NO: 2093 - RNA, 38 nt, Artificial Sequence
  Description of Artificial Sequence:  Enzymatic Nucleic Acid
  misc_feature (31)..(31): n stands for inosine
uucagaugcugaugaggccguuaggccgaanuuagguc

SEQ ID NO: 2094 - RNA, 38 nt, Artificial Sequence
  Description of Artificial Sequence:  Enzymatic Nucleic Acid
  misc_feature (31)..(31): n stands for inosine
auuucagacugaugaggccguuaggccgaanuguuagg

SEQ ID NO: 2095 - RNA, 38 nt, Artificial Sequence
  Description of Artificial Sequence:  Enzymatic Nucleic Acid
  misc_feature (31)..(31): n stands for inosine
aguauuuccugaugaggccguuaggccgaanauguguu

SEQ ID NO: 2096 - RNA, 38 nt, Artificial Sequence
  Description of Artificial Sequence:  Enzymatic Nucleic Acid
  misc_feature (31)..(31): n stands for inosine
agguccuucugaugaggccguuaggccgaanuauuuca

SEQ ID NO: 2097 - RNA, 38 nt, Artificial Sequence
  Description of Artificial Sequence:  Enzymatic Nucleic Acid
  misc_feature (31)..(31): n stands for inosine
acagucaacugaugaggccguuaggccgaanuccuuag

SEQ ID NO: 2098 - RNA, 38 nt, Artificial Sequence
  Description of Artificial Sequence:  Enzymatic Nucleic Acid
  misc_feature (31)..(31): n stands for inosine
cacagucacugaugaggccguuaggccgaanguccuua

SEQ ID NO: 2099 - RNA, 38 nt, Artificial Sequence
  Description of Artificial Sequence:  Enzymatic Nucleic Acid
  misc_feature (31)..(31): n stands for inosine
uuccacaccugaugaggccguuaggccgaanucaaggu

SEQ ID NO: 2100 - RNA, 38 nt, Artificial Sequence
  Description of Artificial Sequence:  Enzymatic Nucleic Acid
  misc_feature (31)..(31): n stands for inosine
uuucucugcugaugaggccguuaggccgaancuuuucu

SEQ ID NO: 2101 - RNA, 38 nt, Artificial Sequence
  Description of Artificial Sequence:  Enzymatic Nucleic Acid
  misc_feature (31)..(31): n stands for inosine
uuuucucucugaugaggccguuaggccgaangcuuuuc

SEQ ID NO: 2102 - RNA, 38 nt, Artificial Sequence
  Description of Artificial Sequence:  Enzymatic Nucleic Acid
  misc_feature (31)..(31): n stands for inosine
uuuuucuccugaugaggccguuaggccgaanggcuuuu

SEQ ID NO: 2103 - RNA, 38 nt, Artificial Sequence
  Description of Artificial Sequence:  Enzymatic Nucleic Acid
  misc_feature (31)..(31): n stands for inosine
aacaugugcugaugaggccguuaggccgaanucguuca

SEQ ID NO: 2104 - RNA, 38 nt, Artificial Sequence
  Description of Artificial Sequence:  Enzymatic Nucleic Acid
  misc_feature (31)..(31): n stands for inosine
cuaacaugcugaugaggccguuaggccgaanugucguu

SEQ ID NO: 2105 - RNA, 38 nt, Artificial Sequence
  Description of Artificial Sequence:  Enzymatic Nucleic Acid
  misc_feature (31)..(31): n stands for inosine
cucuaacacugaugaggccguuaggccgaanugugucg

SEQ ID NO: 2106 - RNA, 38 nt, Artificial Sequence
  Description of Artificial Sequence:  Enzymatic Nucleic Acid
  misc_feature (31)..(31): n stands for inosine
uucagaagcugaugaggccguuaggccgaancucuaac

SEQ ID NO: 2107 - RNA, 38 nt, Artificial Sequence
  Description of Artificial Sequence:  Enzymatic Nucleic Acid
  misc_feature (31)..(31): n stands for inosine
uuucagaacugaugaggccguuaggccgaangcucuaa

SEQ ID NO: 2108 - RNA, 38 nt, Artificial Sequence
  Description of Artificial Sequence:  Enzymatic Nucleic Acid
  misc_feature (31)..(31): n stands for inosine
uuuucagacugaugaggccguuaggccgaanggcucua

SEQ ID NO: 2109 - RNA, 38 nt, Artificial Sequence
  Description of Artificial Sequence:  Enzymatic Nucleic Acid
  misc_feature (31)..(31): n stands for inosine
acuuuuuccugaugaggccguuaggccgaanaagggcu

SEQ ID NO: 2110 - RNA, 38 nt, Artificial Sequence
  Description of Artificial Sequence:  Enzymatic Nucleic Acid
  misc_feature (31)..(31): n stands for inosine
cagaagcacugaugaggccguuaggccgaanauacuuu

SEQ ID NO: 2111 - RNA, 38 nt, Artificial Sequence
  Description of Artificial Sequence:  Enzymatic Nucleic Acid
  misc_feature (31)..(31): n stands for inosine
ucagaagccugaugaggccguuaggccgaangauacuu

SEQ ID NO: 2112 - RNA, 38 nt, Artificial Sequence
  Description of Artificial Sequence:  Enzymatic Nucleic Acid
  misc_feature (31)..(31): n stands for inosine
auaucagacugaugaggccguuaggccgaancaggaua

SEQ ID NO: 2113 - RNA, 38 nt, Artificial Sequence
  Description of Artificial Sequence:  Enzymatic Nucleic Acid
  misc_feature (31)..(31): n stands for inosine
ugcauauccugaugaggccguuaggccgaanaagcagg

SEQ ID NO: 2114 - RNA, 38 nt, Artificial Sequence
  Description of Artificial Sequence:  Enzymatic Nucleic Acid
  misc_feature (31)..(31): n stands for inosine
aggaaaaccugaugaggccguuaggccgaancauauca

SEQ ID NO: 2115 - RNA, 38 nt, Artificial Sequence
  Description of Artificial Sequence:  Enzymatic Nucleic Acid
  misc_feature (31)..(31): n stands for inosine
uaauuuaacugaugaggccguuaggccgaanaaaacug

SEQ ID NO: 2116 - RNA, 38 nt, Artificial Sequence
  Description of Artificial Sequence:  Enzymatic Nucleic Acid
  misc_feature (31)..(31): n stands for inosine
auaauuuacugaugaggccguuaggccgaangaaaacu

SEQ ID NO: 2117 - RNA, 38 nt, Artificial Sequence
  Description of Artificial Sequence:  Enzymatic Nucleic Acid
  misc_feature (31)..(31): n stands for inosine
cagauuuucugaugaggccguuaggccgaanauaauuu

SEQ ID NO: 2118 - RNA, 38 nt, Artificial Sequence
  Description of Artificial Sequence:  Enzymatic Nucleic Acid
  misc_feature (31)..(31): n stands for inosine
ucccuagccugaugaggccguuaggccgaanauuuuag

SEQ ID NO: 2119 - RNA, 38 nt, Artificial Sequence
  Description of Artificial Sequence:  Enzymatic Nucleic Acid
  misc_feature (31)..(31): n stands for inosine
uauucccucugaugaggccguuaggccgaancagauuu

SEQ ID NO: 2120 - RNA, 38 nt, Artificial Sequence
  Description of Artificial Sequence:  Enzymatic Nucleic Acid
  misc_feature (31)..(31): n stands for inosine
auaucuaucugaugaggccguuaggccgaanauauucc

SEQ ID NO: 2121 - RNA, 38 nt, Artificial Sequence
  Description of Artificial Sequence:  Enzymatic Nucleic Acid
  misc_feature (31)..(31): n stands for inosine
aaauaaaacugaugaggccguuaggccgaanuaaauau

SEQ ID NO: 2122 - RNA, 38 nt, Artificial Sequence
  Description of Artificial Sequence:  Enzymatic Nucleic Acid
  misc_feature (31)..(31): n stands for inosine
aaaauaaacugaugaggccguuaggccgaanguaaaua

SEQ ID NO: 2123 - RNA, 38 nt, Artificial Sequence
  Description of Artificial Sequence:  Enzymatic Nucleic Acid
  misc_feature (31)..(31): n stands for inosine
aaauuaaacugaugaggccguuaggccgaanaaacauu

SEQ ID NO: 2124 - RNA, 38 nt, Artificial Sequence
  Description of Artificial Sequence:  Enzymatic Nucleic Acid
  misc_feature (31)..(31): n stands for inosine
aaaauuaacugaugaggccguuaggccgaangaaacau

SEQ ID NO: 2125 - RNA, 38 nt, Artificial Sequence
  Description of Artificial Sequence:  Enzymatic Nucleic Acid
  misc_feature (31)..(31): n stands for inosine
guaaaaaucugaugaggccguuaggccgaanuaaaaaa

SEQ ID NO: 2126 - RNA, 38 nt, Artificial Sequence
  Description of Artificial Sequence:  Enzymatic Nucleic Acid
  misc_feature (31)..(31): n stands for inosine
gaaagauucugaugaggccguuaggccgaanuaaaaau

SEQ ID NO: 2127 - RNA, 38 nt, Artificial Sequence
  Description of Artificial Sequence:  Enzymatic Nucleic Acid
  misc_feature (31)..(31): n stands for inosine
cugcagaacugaugaggccguuaggccgaanauuagua

SEQ ID NO: 2128 - RNA, 38 nt, Artificial Sequence
  Description of Artificial Sequence:  Enzymatic Nucleic Acid
  misc_feature (31)..(31): n stands for inosine
guuucugccugaugaggccguuaggccgaanaaagauu

SEQ ID NO: 2129 - RNA, 38 nt, Artificial Sequence
  Description of Artificial Sequence:  Enzymatic Nucleic Acid
  misc_feature (31)..(31): n stands for inosine
ucuguuuccugaugaggccguuaggccgaancagaaag

SEQ ID NO: 2130 - RNA, 38 nt, Artificial Sequence
  Description of Artificial Sequence:  Enzymatic Nucleic Acid
  misc_feature (31)..(31): n stands for inosine
aaccuuuccugaugaggccguuaggccgaanuuucugc

SEQ ID NO: 2131 - RNA, 38 nt, Artificial Sequence
  Description of Artificial Sequence:  Enzymatic Nucleic Acid
  misc_feature (31)..(31): n stands for inosine
caaaaagacugaugaggccguuaggccgaanaaaaccu

SEQ ID NO: 2132 - RNA, 38 nt, Artificial Sequence
  Description of Artificial Sequence:  Enzymatic Nucleic Acid
  misc_feature (31)..(31): n stands for inosine
aagcaaaacugaugaggccguuaggccgaanaagaaaa

SEQ ID NO: 2133 - RNA, 38 nt, Artificial Sequence
  Description of Artificial Sequence:  Enzymatic Nucleic Acid
  misc_feature (31)..(31): n stands for inosine
guuuuugacugaugaggccguuaggccgaancaaaaag

SEQ ID NO: 2134 - RNA, 38 nt, Artificial Sequence
  Description of Artificial Sequence:  Enzymatic Nucleic Acid
  misc_feature (31)..(31): n stands for inosine
aauguuuucugaugaggccguuaggccgaanaagcaaa

SEQ ID NO: 2135 - RNA, 38 nt, Artificial Sequence
  Description of Artificial Sequence:  Enzymatic Nucleic Acid
  misc_feature (31)..(31): n stands for inosine
uguaagaacugaugaggccguuaggccgaanuuuuuga

SEQ ID NO: 2136 - RNA, 38 nt, Artificial Sequence
  Description of Artificial Sequence:  Enzymatic Nucleic Acid
  misc_feature (31)..(31): n stands for inosine
aaaauguacugaugaggccguuaggccgaanaauguuu

SEQ ID NO: 2137 - RNA, 38 nt, Artificial Sequence
  Description of Artificial Sequence:  Enzymatic Nucleic Acid
  misc_feature (31)..(31): n stands for inosine
aaguaaaacugaugaggccguuaggccgaanuaagaau

SEQ ID NO: 2138 - RNA, 38 nt, Artificial Sequence
  Description of Artificial Sequence:  Enzymatic Nucleic Acid
  misc_feature (31)..(31): n stands for inosine
caggaaaacugaugaggccguuaggccgaanuaaaaug

SEQ ID NO: 2139 - RNA, 38 nt, Artificial Sequence
  Description of Artificial Sequence:  Enzymatic Nucleic Acid
  misc_feature (31)..(31): n stands for inosine
augagccacugaugaggccguuaggccgaanaaaaagu

SEQ ID NO: 2140 - RNA, 38 nt, Artificial Sequence
  Description of Artificial Sequence:  Enzymatic Nucleic Acid
  misc_feature (31)..(31): n stands for inosine
gaugagcccugaugaggccguuaggccgaangaaaaag

SEQ ID NO: 2141 - RNA, 38 nt, Artificial Sequence
  Description of Artificial Sequence:  Enzymatic Nucleic Acid
  misc_feature (31)..(31): n stands for inosine
aagagaugcugaugaggccguuaggccgaanccaggaa

SEQ ID NO: 2142 - RNA, 38 nt, Artificial Sequence
  Description of Artificial Sequence:  Enzymatic Nucleic Acid
  misc_feature (31)..(31): n stands for inosine
uaaagagacugaugaggccguuaggccgaanagccagg

SEQ ID NO: 2143 - RNA, 38 nt, Artificial Sequence
  Description of Artificial Sequence:  Enzymatic Nucleic Acid
  misc_feature (31)..(31): n stands for inosine
gaauaaagcugaugaggccguuaggccgaanaugagcc

SEQ ID NO: 2144 - RNA, 38 nt, Artificial Sequence
  Description of Artificial Sequence:  Enzymatic Nucleic Acid
  misc_feature (31)..(31): n stands for inosine
aagaauaacugaugaggccguuaggccgaanagaugag

SEQ ID NO: 2145 - RNA, 38 nt, Artificial Sequence
  Description of Artificial Sequence:  Enzymatic Nucleic Acid
  misc_feature (31)..(31): n stands for inosine
aaaaaaaacugaugaggccguuaggccgaanaauaaag

SEQ ID NO: 2146 - RNA, 38 nt, Artificial Sequence
  Description of Artificial Sequence:  Enzymatic Nucleic Acid
  misc_feature (31)..(31): n stands for inosine
cgagacuccugaugaggccguuaggccgaanucuuuaa

SEQ ID NO: 2147 - RNA, 38 nt, Artificial Sequence
  Description of Artificial Sequence:  Enzymatic Nucleic Acid
  misc_feature (31)..(31): n stands for inosine
acagagcgcugaugaggccguuaggccgaanacucugu

SEQ ID NO: 2148 - RNA, 38 nt, Artificial Sequence
  Description of Artificial Sequence:  Enzymatic Nucleic Acid
  misc_feature (31)..(31): n stands for inosine
ggcaacagcugaugaggccguuaggccgaancgagacu

SEQ ID NO: 2149 - RNA, 38 nt, Artificial Sequence
  Description of Artificial Sequence:  Enzymatic Nucleic Acid
  misc_feature (31)..(31): n stands for inosine
ugggcaaccugaugaggccguuaggccgaanagcgaga

SEQ ID NO: 2150 - RNA, 38 nt, Artificial Sequence
  Description of Artificial Sequence:  Enzymatic Nucleic Acid
  misc_feature (31)..(31): n stands for inosine
ccagccugcugaugaggccguuaggccgaancaacaga

SEQ ID NO: 2151 - RNA, 38 nt, Artificial Sequence
  Description of Artificial Sequence:  Enzymatic Nucleic Acid
  misc_feature (31)..(31): n stands for inosine
uccagccucugaugaggccguuaggccgaangcaacag

SEQ ID NO: 2152 - RNA, 38 nt, Artificial Sequence
  Description of Artificial Sequence:  Enzymatic Nucleic Acid
  misc_feature (31)..(31): n stands for inosine
cuccagcccugaugaggccguuaggccgaanggcaaca

SEQ ID NO: 2153 - RNA, 38 nt, Artificial Sequence
  Description of Artificial Sequence:  Enzymatic Nucleic Acid
  misc_feature (31)..(31): n stands for inosine
ugcacucccugaugaggccguuaggccgaanccugggc

SEQ ID NO: 2154 - RNA, 38 nt, Artificial Sequence
  Description of Artificial Sequence:  Enzymatic Nucleic Acid
  misc_feature (31)..(31): n stands for inosine
ugugucaucugaugaggccguuaggccgaancacucca

SEQ ID NO: 2155 - RNA, 38 nt, Artificial Sequence
  Description of Artificial Sequence:  Enzymatic Nucleic Acid
  misc_feature (31)..(31): n stands for inosine
caagacugcugaugaggccguuaggccgaanucauugc

SEQ ID NO: 2156 - RNA, 38 nt, Artificial Sequence
  Description of Artificial Sequence:  Enzymatic Nucleic Acid
  misc_feature (31)..(31): n stands for inosine
gccaagaccugaugaggccguuaggccgaanugucauu

SEQ ID NO: 2157 - RNA, 38 nt, Artificial Sequence
  Description of Artificial Sequence:  Enzymatic Nucleic Acid
  misc_feature (31)..(31): n stands for inosine
gugagccacugaugaggccguuaggccgaanacugugu

SEQ ID NO: 2158 - RNA, 38 nt, Artificial Sequence
  Description of Artificial Sequence:  Enzymatic Nucleic Acid
  misc_feature (31)..(31): n stands for inosine
uugcagugcugaugaggccguuaggccgaanccaagac

SEQ ID NO: 2159 - RNA, 38 nt, Artificial Sequence
  Description of Artificial Sequence:  Enzymatic Nucleic Acid
  misc_feature (31)..(31): n stands for inosine
aguugcagcugaugaggccguuaggccgaanagccaag

SEQ ID NO: 2160 - RNA, 38 nt, Artificial Sequence
  Description of Artificial Sequence:  Enzymatic Nucleic Acid
  misc_feature (31)..(31): n stands for inosine
gaaguugccugaugaggccguuaggccgaanugagcca

SEQ ID NO: 2161 - RNA, 38 nt, Artificial Sequence
  Description of Artificial Sequence:  Enzymatic Nucleic Acid
  misc_feature (31)..(31): n stands for inosine
gcagaagucugaugaggccguuaggccgaancagugag

SEQ ID NO: 2162 - RNA, 38 nt, Artificial Sequence
  Description of Artificial Sequence:  Enzymatic Nucleic Acid
  misc_feature (31)..(31): n stands for inosine
gaggcagacugaugaggccguuaggccgaanuugcagu

SEQ ID NO: 2163 - RNA, 38 nt, Artificial Sequence
  Description of Artificial Sequence:  Enzymatic Nucleic Acid
  misc_feature (31)..(31): n stands for inosine
caagaggccugaugaggccguuaggccgaanaaguugc

SEQ ID NO: 2164 - RNA, 38 nt, Artificial Sequence
  Description of Artificial Sequence:  Enzymatic Nucleic Acid
  misc_feature (31)..(31): n stands for inosine
acccaagacugaugaggccguuaggccgaancagaagu

SEQ ID NO: 2165 - RNA, 38 nt, Artificial Sequence
  Description of Artificial Sequence:  Enzymatic Nucleic Acid
  misc_feature (31)..(31): n stands for inosine
aacccaagcugaugaggccguuaggccgaangcagaag

SEQ ID NO: 2166 - RNA, 38 nt, Artificial Sequence
  Description of Artificial Sequence:  Enzymatic Nucleic Acid
  misc_feature (31)..(31): n stands for inosine
ugaacccacugaugaggccguuaggccgaanaggcaga

SEQ ID NO: 2167 - RNA, 38 nt, Artificial Sequence
  Description of Artificial Sequence:  Enzymatic Nucleic Acid
  misc_feature (31)..(31): n stands for inosine
gaaucacucugaugaggccguuaggccgaanaacccaa

SEQ ID NO: 2168 - RNA, 38 nt, Artificial Sequence
  Description of Artificial Sequence:  Enzymatic Nucleic Acid
  misc_feature (31)..(31): n stands for inosine
gaggcaggcugaugaggccguuaggccgaanaaucacu

SEQ ID NO: 2169 - RNA, 38 nt, Artificial Sequence
  Description of Artificial Sequence:  Enzymatic Nucleic Acid
  misc_feature (31)..(31): n stands for inosine
cugaggcacugaugaggccguuaggccgaanagaauca

SEQ ID NO: 2170 - RNA, 38 nt, Artificial Sequence
  Description of Artificial Sequence:  Enzymatic Nucleic Acid
  misc_feature (31)..(31): n stands for inosine
gcugaggccugaugaggccguuaggccgaangagaauc

SEQ ID NO: 2171 - RNA, 38 nt, Artificial Sequence
  Description of Artificial Sequence:  Enzymatic Nucleic Acid
  misc_feature (31)..(31): n stands for inosine
gaggcugacugaugaggccguuaggccgaancaggaga

SEQ ID NO: 2172 - RNA, 38 nt, Artificial Sequence
  Description of Artificial Sequence:  Enzymatic Nucleic Acid
  misc_feature (31)..(31): n stands for inosine
ggaggcugcugaugaggccguuaggccgaangcaggag

SEQ ID NO: 2173 - RNA, 38 nt, Artificial Sequence
  Description of Artificial Sequence:  Enzymatic Nucleic Acid
  misc_feature (31)..(31): n stands for inosine
caggaggccugaugaggccguuaggccgaanaggcagg

SEQ ID NO: 2174 - RNA, 38 nt, Artificial Sequence
  Description of Artificial Sequence:  Enzymatic Nucleic Acid
  misc_feature (31)..(31): n stands for inosine
acucaggacugaugaggccguuaggccgaancugaggc

SEQ ID NO: 2175 - RNA, 38 nt, Artificial Sequence
  Description of Artificial Sequence:  Enzymatic Nucleic Acid
  misc_feature (31)..(31): n stands for inosine
uacucaggcugaugaggccguuaggccgaangcugagg

SEQ ID NO: 2176 - RNA, 38 nt, Artificial Sequence
  Description of Artificial Sequence:  Enzymatic Nucleic Acid
  misc_feature (31)..(31): n stands for inosine
gcuacucacugaugaggccguuaggccgaanaggcuga

SEQ ID NO: 2177 - RNA, 38 nt, Artificial Sequence
  Description of Artificial Sequence:  Enzymatic Nucleic Acid
  misc_feature (31)..(31): n stands for inosine
agcuacuccugaugaggccguuaggccgaangaggcug

SEQ ID NO: 2178 - RNA, 38 nt, Artificial Sequence
  Description of Artificial Sequence:  Enzymatic Nucleic Acid
  misc_feature (31)..(31): n stands for inosine
uguaaucccugaugaggccguuaggccgaancuacuca

SEQ ID NO: 2179 - RNA, 38 nt, Artificial Sequence
  Description of Artificial Sequence:  Enzymatic Nucleic Acid
  misc_feature (31)..(31): n stands for inosine
cacaugcccugaugaggccguuaggccgaanuaaucca

SEQ ID NO: 2180 - RNA, 38 nt, Artificial Sequence
  Description of Artificial Sequence:  Enzymatic Nucleic Acid
  misc_feature (31)..(31): n stands for inosine
guggcacacugaugaggccguuaggccgaanccuguaa

SEQ ID NO: 2181 - RNA, 38 nt, Artificial Sequence
  Description of Artificial Sequence:  Enzymatic Nucleic Acid
  misc_feature (31)..(31): n stands for inosine
gggugggucugaugaggccguuaggccgaancacaugc

SEQ ID NO: 2182 - RNA, 38 nt, Artificial Sequence
  Description of Artificial Sequence:  Enzymatic Nucleic Acid
  misc_feature (31)..(31): n stands for inosine
ugggugggcugaugaggccguuaggccgaangcacaug

SEQ ID NO: 2183 - RNA, 38 nt, Artificial Sequence
  Description of Artificial Sequence:  Enzymatic Nucleic Acid
  misc_feature (31)..(31): n stands for inosine
guugggugcugaugaggccguuaggccgaanuggcaca

SEQ ID NO: 2184 - RNA, 38 nt, Artificial Sequence
  Description of Artificial Sequence:  Enzymatic Nucleic Acid
  misc_feature (31)..(31): n stands for inosine
aguugggucugaugaggccguuaggccgaanguggcac

SEQ ID NO: 2185 - RNA, 38 nt, Artificial Sequence
  Description of Artificial Sequence:  Enzymatic Nucleic Acid
  misc_feature (31)..(31): n stands for inosine
uaguugggcugaugaggccguuaggccgaangguggca

SEQ ID NO: 2186 - RNA, 38 nt, Artificial Sequence
  Description of Artificial Sequence:  Enzymatic Nucleic Acid
  misc_feature (31)..(31): n stands for inosine
auuaguugcugaugaggccguuaggccgaanugggugg

SEQ ID NO: 2187 - RNA, 38 nt, Artificial Sequence
  Description of Artificial Sequence:  Enzymatic Nucleic Acid
  misc_feature (31)..(31): n stands for inosine
aauuaguucugaugaggccguuaggccgaangugggug

SEQ ID NO: 2188 - RNA, 38 nt, Artificial Sequence
  Description of Artificial Sequence:  Enzymatic Nucleic Acid
  misc_feature (31)..(31): n stands for inosine
aaauuagucugaugaggccguuaggccgaanggugggu

SEQ ID NO: 2189 - RNA, 38 nt, Artificial Sequence
  Description of Artificial Sequence:  Enzymatic Nucleic Acid
  misc_feature (31)..(31): n stands for inosine
caaaaauucugaugaggccguuaggccgaanuugggug

SEQ ID NO: 2190 - RNA, 38 nt, Artificial Sequence
  Description of Artificial Sequence:  Enzymatic Nucleic Acid
  misc_feature (31)..(31): n stands for inosine
ugaaaccccugaugaggccguuaggccgaanucuuuau

SEQ ID NO: 2191 - RNA, 38 nt, Artificial Sequence
  Description of Artificial Sequence:  Enzymatic Nucleic Acid
  misc_feature (31)..(31): n stands for inosine
caacauggcugaugaggccguuaggccgaanaaacccu

SEQ ID NO: 2192 - RNA, 38 nt, Artificial Sequence
  Description of Artificial Sequence:  Enzymatic Nucleic Acid
  misc_feature (31)..(31): n stands for inosine
gccaacaucugaugaggccguuaggccgaanugaaacc

SEQ ID NO: 2193 - RNA, 38 nt, Artificial Sequence
  Description of Artificial Sequence:  Enzymatic Nucleic Acid
  misc_feature (31)..(31): n stands for inosine
ggccaacacugaugaggccguuaggccgaangugaaac

SEQ ID NO: 2194 - RNA, 38 nt, Artificial Sequence
  Description of Artificial Sequence:  Enzymatic Nucleic Acid
  misc_feature (31)..(31): n stands for inosine
accagccucugaugaggccguuaggccgaanccaacau

SEQ ID NO: 2195 - RNA, 38 nt, Artificial Sequence
  Description of Artificial Sequence:  Enzymatic Nucleic Acid
  misc_feature (31)..(31): n stands for inosine
gaccagcccugaugaggccguuaggccgaangccaaca

SEQ ID NO: 2196 - RNA, 38 nt, Artificial Sequence
  Description of Artificial Sequence:  Enzymatic Nucleic Acid
  misc_feature (31)..(31): n stands for inosine
uugagacccugaugaggccguuaggccgaanccuggcc

SEQ ID NO: 2197 - RNA, 38 nt, Artificial Sequence
  Description of Artificial Sequence:  Enzymatic Nucleic Acid
  misc_feature (31)..(31): n stands for inosine
ggaguuugcugaugaggccguuaggccgaanaccagcc

SEQ ID NO: 2198 - RNA, 38 nt, Artificial Sequence
  Description of Artificial Sequence:  Enzymatic Nucleic Acid
  misc_feature (31)..(31): n stands for inosine
caggaguucugaugaggccguuaggccgaanagaccag

SEQ ID NO: 2199 - RNA, 38 nt, Artificial Sequence
  Description of Artificial Sequence:  Enzymatic Nucleic Acid
  misc_feature (31)..(31): n stands for inosine
aggucaggcugaugaggccguuaggccgaanuuugaga

SEQ ID NO: 2200 - RNA, 38 nt, Artificial Sequence
  Description of Artificial Sequence:  Enzymatic Nucleic Acid
  misc_feature (31)..(31): n stands for inosine
ugaggucacugaugaggccguuaggccgaanaguuuga

SEQ ID NO: 2201 - RNA, 38 nt, Artificial Sequence
  Description of Artificial Sequence:  Enzymatic Nucleic Acid
  misc_feature (31)..(31): n stands for inosine
uugagguccugaugaggccguuaggccgaangaguuug

SEQ ID NO: 2202 - RNA, 38 nt, Artificial Sequence
  Description of Artificial Sequence:  Enzymatic Nucleic Acid
  misc_feature (31)..(31): n stands for inosine
uuacuugacugaugaggccguuaggccgaanucaggag

SEQ ID NO: 2203 - RNA, 38 nt, Artificial Sequence
  Description of Artificial Sequence:  Enzymatic Nucleic Acid
  misc_feature (31)..(31): n stands for inosine
auuacuugcugaugaggccguuaggccgaangucagga

SEQ ID NO: 2204 - RNA, 38 nt, Artificial Sequence
  Description of Artificial Sequence:  Enzymatic Nucleic Acid
  misc_feature (31)..(31): n stands for inosine
ggauuacucugaugaggccguuaggccgaanaggucag

SEQ ID NO: 2205 - RNA, 38 nt, Artificial Sequence
  Description of Artificial Sequence:  Enzymatic Nucleic Acid
  misc_feature (31)..(31): n stands for inosine
aggcaggucugaugaggccguuaggccgaanauuacuu

SEQ ID NO: 2206 - RNA, 38 nt, Artificial Sequence
  Description of Artificial Sequence:  Enzymatic Nucleic Acid
  misc_feature (31)..(31): n stands for inosine
gaggcaggcugaugaggccguuaggccgaangauuacu

SEQ ID NO: 2207 - RNA, 38 nt, Artificial Sequence
  Description of Artificial Sequence:  Enzymatic Nucleic Acid
  misc_feature (31)..(31): n stands for inosine
ccgaggcacugaugaggccguuaggccgaanuggauua

SEQ ID NO: 2208 - RNA, 38 nt, Artificial Sequence
  Description of Artificial Sequence:  Enzymatic Nucleic Acid
  misc_feature (31)..(31): n stands for inosine
gccgaggccugaugaggccguuaggccgaanguggauu

SEQ ID NO: 2209 - RNA, 38 nt, Artificial Sequence
  Description of Artificial Sequence:  Enzymatic Nucleic Acid
  misc_feature (31)..(31): n stands for inosine
gaggccgacugaugaggccguuaggccgaancaggugg

SEQ ID NO: 2210 - RNA, 38 nt, Artificial Sequence
  Description of Artificial Sequence:  Enzymatic Nucleic Acid
  misc_feature (31)..(31): n stands for inosine
ggaggccgcugaugaggccguuaggccgaangcaggug

SEQ ID NO: 2211 - RNA, 38 nt, Artificial Sequence
  Description of Artificial Sequence:  Enzymatic Nucleic Acid
  misc_feature (31)..(31): n stands for inosine
cuuugggacugaugaggccguuaggccgaanccgaggc

SEQ ID NO: 2212 - RNA, 38 nt, Artificial Sequence
  Description of Artificial Sequence:  Enzymatic Nucleic Acid
  misc_feature (31)..(31): n stands for inosine
acuuugggcugaugaggccguuaggccgaangccgagg

SEQ ID NO: 2213 - RNA, 38 nt, Artificial Sequence
  Description of Artificial Sequence:  Enzymatic Nucleic Acid
  misc_feature (31)..(31): n stands for inosine
gcacuuugcugaugaggccguuaggccgaanaggccga

SEQ ID NO: 2214 - RNA, 38 nt, Artificial Sequence
  Description of Artificial Sequence:  Enzymatic Nucleic Acid
  misc_feature (31)..(31): n stands for inosine
agcacuuucugaugaggccguuaggccgaangaggccg

SEQ ID NO: 2215 - RNA, 38 nt, Artificial Sequence
  Description of Artificial Sequence:  Enzymatic Nucleic Acid
  misc_feature (31)..(31): n stands for inosine
cagcacuucugaugaggccguuaggccgaanggaggcc

SEQ ID NO: 2216 - RNA, 38 nt, Artificial Sequence
  Description of Artificial Sequence:  Enzymatic Nucleic Acid
  misc_feature (31)..(31): n stands for inosine
guaauccccugaugaggccguuaggccgaancacuuug

SEQ ID NO: 2217 - RNA, 38 nt, Artificial Sequence
  Description of Artificial Sequence:  Enzymatic Nucleic Acid
  misc_feature (31)..(31): n stands for inosine
cucauccccugaugaggccguuaggccgaanuaauccc

SEQ ID NO: 2218 - RNA, 38 nt, Artificial Sequence
  Description of Artificial Sequence:  Enzymatic Nucleic Acid
  misc_feature (31)..(31): n stands for inosine
ggcgcggucugaugaggccguuaggccgaancucaucc

SEQ ID NO: 2219 - RNA, 38 nt, Artificial Sequence
  Description of Artificial Sequence:  Enzymatic Nucleic Acid
  misc_feature (31)..(31): n stands for inosine
gggcgcggcugaugaggccguuaggccgaangcucauc

SEQ ID NO: 2220 - RNA, 38 nt, Artificial Sequence
  Description of Artificial Sequence:  Enzymatic Nucleic Acid
  misc_feature (31)..(31): n stands for inosine
cugggcgccugaugaggccguuaggccgaanuggcuca

SEQ ID NO: 2221 - RNA, 38 nt, Artificial Sequence
  Description of Artificial Sequence:  Enzymatic Nucleic Acid
  misc_feature (31)..(31): n stands for inosine
ugaggcugcugaugaggccguuaggccgaancgcggug

SEQ ID NO: 2222 - RNA, 38 nt, Artificial Sequence
  Description of Artificial Sequence:  Enzymatic Nucleic Acid
  misc_feature (31)..(31): n stands for inosine
augaggcucugaugaggccguuaggccgaangcgcggu

SEQ ID NO: 2223 - RNA, 38 nt, Artificial Sequence
  Description of Artificial Sequence:  Enzymatic Nucleic Acid
  misc_feature (31)..(31): n stands for inosine
gaugaggccugaugaggccguuaggccgaanggcgcgg

SEQ ID NO: 2224 - RNA, 38 nt, Artificial Sequence
  Description of Artificial Sequence:  Enzymatic Nucleic Acid
  misc_feature (31)..(31): n stands for inosine
agagaugacugaugaggccguuaggccgaancugggcg

SEQ ID NO: 2225 - RNA, 38 nt, Artificial Sequence
  Description of Artificial Sequence:  Enzymatic Nucleic Acid
  misc_feature (31)..(31): n stands for inosine
aagagaugcugaugaggccguuaggccgaangcugggc

SEQ ID NO: 2226 - RNA, 38 nt, Artificial Sequence
  Description of Artificial Sequence:  Enzymatic Nucleic Acid
  misc_feature (31)..(31): n stands for inosine
caaagagacugaugaggccguuaggccgaanaggcugg

SEQ ID NO: 2227 - RNA, 38 nt, Artificial Sequence
  Description of Artificial Sequence:  Enzymatic Nucleic Acid
  misc_feature (31)..(31): n stands for inosine
gaacaaagcugaugaggccguuaggccgaanaugaggc

SEQ ID NO: 2228 - RNA, 38 nt, Artificial Sequence
  Description of Artificial Sequence:  Enzymatic Nucleic Acid
  misc_feature (31)..(31): n stands for inosine
uagaacaacugaugaggccguuaggccgaanagaugag

SEQ ID NO: 2229 - RNA, 38 nt, Artificial Sequence
  Description of Artificial Sequence:  Enzymatic Nucleic Acid
  misc_feature (31)..(31): n stands for inosine
ccaucuuucugaugaggccguuaggccgaanaacaaag

SEQ ID NO: 2230 - RNA, 38 nt, Artificial Sequence
  Description of Artificial Sequence:  Enzymatic Nucleic Acid
  misc_feature (31)..(31): n stands for inosine
uugggggucugaugaggccguuaggccgaanuuuuucc

SEQ ID NO: 2231 - RNA, 38 nt, Artificial Sequence
  Description of Artificial Sequence:  Enzymatic Nucleic Acid
  misc_feature (31)..(31): n stands for inosine
uuugggggcugaugaggccguuaggccgaanguuuuuc

SEQ ID NO: 2232 - RNA, 38 nt, Artificial Sequence
  Description of Artificial Sequence:  Enzymatic Nucleic Acid
  misc_feature (31)..(31): n stands for inosine
aauuugggcugaugaggccguuaggccgaanugguuuu

SEQ ID NO: 2233 - RNA, 38 nt, Artificial Sequence
  Description of Artificial Sequence:  Enzymatic Nucleic Acid
  misc_feature (31)..(31): n stands for inosine
aaauuuggcugaugaggccguuaggccgaangugguuu

SEQ ID NO: 2234 - RNA, 38 nt, Artificial Sequence
  Description of Artificial Sequence:  Enzymatic Nucleic Acid
  misc_feature (31)..(31): n stands for inosine
aaaauuugcugaugaggccguuaggccgaanggugguu

SEQ ID NO: 2235 - RNA, 38 nt, Artificial Sequence
  Description of Artificial Sequence:  Enzymatic Nucleic Acid
  misc_feature (31)..(31): n stands for inosine
gaaaauuucugaugaggccguuaggccgaanggguggu

SEQ ID NO: 2236 - RNA, 38 nt, Artificial Sequence
  Description of Artificial Sequence:  Enzymatic Nucleic Acid
  misc_feature (31)..(31): n stands for inosine
agaaaauucugaugaggccguuaggccgaanggggugg

SEQ ID NO: 2237 - RNA, 38 nt, Artificial Sequence
  Description of Artificial Sequence:  Enzymatic Nucleic Acid
  misc_feature (31)..(31): n stands for inosine
guauaaaacugaugaggccguuaggccgaanaaaauuu

SEQ ID NO: 2238 - RNA, 38 nt, Artificial Sequence
  Description of Artificial Sequence:  Enzymatic Nucleic Acid
  misc_feature (31)..(31): n stands for inosine
ucauuaaucugaugaggccguuaggccgaanuauaaaa

SEQ ID NO: 2239 - RNA, 38 nt, Artificial Sequence
  Description of Artificial Sequence:  Enzymatic Nucleic Acid
  misc_feature (31)..(31): n stands for inosine
gaauugaucugaugaggccguuaggccgaanauucauu

SEQ ID NO: 2240 - RNA, 38 nt, Artificial Sequence
  Description of Artificial Sequence:  Enzymatic Nucleic Acid
  misc_feature (31)..(31): n stands for inosine
auaugaaucugaugaggccguuaggccgaanauugauu

SEQ ID NO: 2241 - RNA, 38 nt, Artificial Sequence
  Description of Artificial Sequence:  Enzymatic Nucleic Acid
  misc_feature (31)..(31): n stands for inosine
aauagauacugaugaggccguuaggccgaanaauugau

SEQ ID NO: 2242 - RNA, 38 nt, Artificial Sequence
  Description of Artificial Sequence:  Enzymatic Nucleic Acid
  misc_feature (31)..(31): n stands for inosine
uaauaaaucugaugaggccguuaggccgaanauaugaa

SEQ ID NO: 2243 - RNA, 38 nt, Artificial Sequence
  Description of Artificial Sequence:  Enzymatic Nucleic Acid
  misc_feature (31)..(31): n stands for inosine
aaagcggucugaugaggccguuaggccgaanaaauuua

SEQ ID NO: 2244 - RNA, 38 nt, Artificial Sequence
  Description of Artificial Sequence:  Enzymatic Nucleic Acid
  misc_feature (31)..(31): n stands for inosine
cuaaaagccugaugaggccguuaggccgaanuagaaau

SEQ ID NO: 2245 - RNA, 38 nt, Artificial Sequence
  Description of Artificial Sequence:  Enzymatic Nucleic Acid
  misc_feature (31)..(31): n stands for inosine
ggccuaaacugaugaggccguuaggccgaancgguaga

SEQ ID NO: 2246 - RNA, 38 nt, Artificial Sequence
  Description of Artificial Sequence:  Enzymatic Nucleic Acid
  misc_feature (31)..(31): n stands for inosine
auuuuuuucugaugaggccguuaggccgaanccuaaaa

SEQ ID NO: 2247 - RNA, 38 nt, Artificial Sequence
  Description of Artificial Sequence:  Enzymatic Nucleic Acid
  misc_feature (31)..(31): n stands for inosine
cauuuuuucugaugaggccguuaggccgaangccuaaa

SEQ ID NO: 2248 - RNA, 38 nt, Artificial Sequence
  Description of Artificial Sequence:  Enzymatic Nucleic Acid
  misc_feature (31)..(31): n stands for inosine
ugaggcagcugaugaggccguuaggccgaanaacgauc

SEQ ID NO: 2249 - RNA, 38 nt, Artificial Sequence
  Description of Artificial Sequence:  Enzymatic Nucleic Acid
  misc_feature (31)..(31): n stands for inosine
ugugaggccugaugaggccguuaggccgaanagaacga

SEQ ID NO: 2250 - RNA, 38 nt, Artificial Sequence
  Description of Artificial Sequence:  Enzymatic Nucleic Acid
  misc_feature (31)..(31): n stands for inosine
cuaugugacugaugaggccguuaggccgaancagagaa

SEQ ID NO: 2251 - RNA, 38 nt, Artificial Sequence
  Description of Artificial Sequence:  Enzymatic Nucleic Acid
  misc_feature (31)..(31): n stands for inosine
gcuaugugcugaugaggccguuaggccgaangcagaga

SEQ ID NO: 2252 - RNA, 38 nt, Artificial Sequence
  Description of Artificial Sequence:  Enzymatic Nucleic Acid
  misc_feature (31)..(31): n stands for inosine
aagcuaugcugaugaggccguuaggccgaanaggcaga

SEQ ID NO: 2253 - RNA, 38 nt, Artificial Sequence
  Description of Artificial Sequence:  Enzymatic Nucleic Acid
  misc_feature (31)..(31): n stands for inosine
guaagcuacugaugaggccguuaggccgaanugaggca

SEQ ID NO: 2254 - RNA, 38 nt, Artificial Sequence
  Description of Artificial Sequence:  Enzymatic Nucleic Acid
  misc_feature (31)..(31): n stands for inosine
ggcuuguacugaugaggccguuaggccgaancuaugug

SEQ ID NO: 2255 - RNA, 38 nt, Artificial Sequence
  Description of Artificial Sequence:  Enzymatic Nucleic Acid
  misc_feature (31)..(31): n stands for inosine
agcuggcucugaugaggccguuaggccgaanuaagcua

SEQ ID NO: 2256 - RNA, 38 nt, Artificial Sequence
  Description of Artificial Sequence:  Enzymatic Nucleic Acid
  misc_feature (31)..(31): n stands for inosine
cuccagcucugaugaggccguuaggccgaancuuguaa

SEQ ID NO: 2257 - RNA, 38 nt, Artificial Sequence
  Description of Artificial Sequence:  Enzymatic Nucleic Acid
  misc_feature (31)..(31): n stands for inosine
ucuccagccugaugaggccguuaggccgaangcuugua

SEQ ID NO: 2258 - RNA, 38 nt, Artificial Sequence
  Description of Artificial Sequence:  Enzymatic Nucleic Acid
  misc_feature (31)..(31): n stands for inosine
auuucucccugaugaggccguuaggccgaancuggcuu

SEQ ID NO: 2259 - RNA, 38 nt, Artificial Sequence
  Description of Artificial Sequence:  Enzymatic Nucleic Acid
  misc_feature (31)..(31): n stands for inosine
uuuuaaugcugaugaggccguuaggccgaanuaccaua

SEQ ID NO: 2260 - RNA, 38 nt, Artificial Sequence
  Description of Artificial Sequence:  Enzymatic Nucleic Acid
  misc_feature (31)..(31): n stands for inosine
uuuuuuaacugaugaggccguuaggccgaanaguacca

SEQ ID NO: 2261 - RNA, 17 nt, Homo sapiens
cggcggcggcggcgcag

SEQ ID NO: 2262 - RNA, 17 nt, Homo sapiens
cgucagaagcagggagu

SEQ ID NO: 2263 - RNA, 17 nt, Homo sapiens
agcagggaguaguacuu

SEQ ID NO: 2264 - RNA, 17 nt, Homo sapiens
agggaguaguacuuaaa

SEQ ID NO: 2265 - RNA, 17 nt, Homo sapiens
caagaacugccuaauuc

SEQ ID NO: 2266 - RNA, 17 nt, Homo sapiens
gauaggagguuuacauu

SEQ ID NO: 2267 - RNA, 17 nt, Homo sapiens
cauuucaaguuauaaua

SEQ ID NO: 2268 - RNA, 17 nt, Homo sapiens
uccagaaggugaaggua

SEQ ID NO: 2269 - RNA, 17 nt, Homo sapiens
aggugaagguagaucaa

SEQ ID NO: 2270 - RNA, 17 nt, Homo sapiens
agaaggaagcaaaaaau

SEQ ID NO: 2271 - RNA, 17 nt, Homo sapiens
caaaaaaugccgcagcc

SEQ ID NO: 2272 - RNA, 17 nt, Homo sapiens
aaaaugccgcagccaaa

SEQ ID NO: 2273 - RNA, 17 nt, Homo sapiens
augccgcagccaaauua

SEQ ID NO: 2274 - RNA, 17 nt, Homo sapiens
ccaaauuagcuguugag

SEQ ID NO: 2275 - RNA, 17 nt, Homo sapiens
aauuagcuguugagaua

SEQ ID NO: 2276 - RNA, 17 nt, Homo sapiens
aaaagaaggcaguuagu

SEQ ID NO: 2277 - RNA, 17 nt, Homo sapiens
agaaggcaguuaguccu

SEQ ID NO: 2278 - RNA, 17 nt, Homo sapiens
ggcaguuaguccuuuau

SEQ ID NO: 2279 - RNA, 17 nt, Homo sapiens
uuacauaggccuuauca

SEQ ID NO: 2280 - RNA, 17 nt, Homo sapiens
auagaauugcccagaag

SEQ ID NO: 2281 - RNA, 17 nt, Homo sapiens
gacuaacuguaaauuau

SEQ ID NO: 2282 - RNA, 17 nt, Homo sapiens
uaugaacagugugcauc

SEQ ID NO: 2283 - RNA, 17 nt, Homo sapiens
ugaacagugugcaucgg

SEQ ID NO: 2284 - RNA, 17 nt, Homo sapiens
aacagugugcaucgggg

SEQ ID NO: 2285 - RNA, 17 nt, Homo sapiens
caucgggggugcauggg

SEQ ID NO: 2286 - RNA, 17 nt, Homo sapiens
ucgggggugcaugggcc

SEQ ID NO: 2287 - RNA, 17 nt, Homo sapiens
gugcaugggccagaagg

SEQ ID NO: 2288 - RNA, 17 nt, Homo sapiens
uuauaaaugcaaaaugg

SEQ ID NO: 2289 - RNA, 17 nt, Homo sapiens
agaauauaguauuggua

SEQ ID NO: 2290 - RNA, 17 nt, Homo sapiens
uaguauugguacagguu

SEQ ID NO: 2291 - RNA, 17 nt, Homo sapiens
ugguacagguucuacua

SEQ ID NO: 2292 - RNA, 17 nt, Homo sapiens
aacaggaagcaaaacaa

SEQ ID NO: 2293 - RNA, 17 nt, Homo sapiens
aacaauuggccgcuaaa

SEQ ID NO: 2294 - RNA, 17 nt, Homo sapiens
aauuggccgcuaaacuu

SEQ ID NO: 2295 - RNA, 17 nt, Homo sapiens
cuaaacuugcauaucuu

SEQ ID NO: 2296 - RNA, 17 nt, Homo sapiens
aaaccucagugaaaucu

SEQ ID NO: 2297 - RNA, 17 nt, Homo sapiens
gacuaccuguccucugg

SEQ ID NO: 2298 - RNA, 17 nt, Homo sapiens
guccucugguucuuuug

SEQ ID NO: 2299 - RNA, 17 nt, Homo sapiens
guucuuuugcuacuacg

SEQ ID NO: 2300 - RNA, 17 nt, Homo sapiens
gcuacuacgugugaguc

SEQ ID NO: 2301 - RNA, 17 nt, Homo sapiens
uacuacgugugaguccc

SEQ ID NO: 2302 - RNA, 17 nt, Homo sapiens
acgugugagucccaaag

SEQ ID NO: 2303 - RNA, 17 nt, Homo sapiens
gucccaaagcaacucuu

SEQ ID NO: 2304 - RNA, 17 nt, Homo sapiens
acucuuuagugaccagc

SEQ ID NO: 2305 - RNA, 17 nt, Homo sapiens
agugaccagcacacucg

SEQ ID NO: 2306 - RNA, 17 nt, Homo sapiens
gcacacucgcuucugaa

SEQ ID NO: 2307 - RNA, 17 nt, Homo sapiens
aucugaaggugacuucu

SEQ ID NO: 2308 - RNA, 17 nt, Homo sapiens
acuucucagcagauaca

SEQ ID NO: 2309 - RNA, 17 nt, Homo sapiens
uucuaacagugacaguu

SEQ ID NO: 2310 - RNA, 17 nt, Homo sapiens
cagugacaguuuaaaca

SEQ ID NO: 2311 - RNA, 17 nt, Homo sapiens
uuuaaacaguucuucgu

SEQ ID NO: 2312 - RNA, 17 nt, Homo sapiens
aguucuucguugcuuau

SEQ ID NO: 2313 - RNA, 17 nt, Homo sapiens
ucuucguugcuuaugaa

SEQ ID NO: 2314 - RNA, 17 nt, Homo sapiens
uaugaauggucucagaa

SEQ ID NO: 2315 - RNA, 17 nt, Homo sapiens
aaaggaaggcaaaaaga

SEQ ID NO: 2316 - RNA, 17 nt, Homo sapiens
gaucuuuggcacccaga

SEQ ID NO: 2317 - RNA, 17 nt, Homo sapiens
gaaacaaaguauacugu

SEQ ID NO: 2318 - RNA, 17 nt, Homo sapiens
aguauacuguggacaag

SEQ ID NO: 2319 - RNA, 17 nt, Homo sapiens
gacaagagguuuggcau

SEQ ID NO: 2320 - RNA, 17 nt, Homo sapiens
gagguuuggcauggauu

SEQ ID NO: 2321 - RNA, 17 nt, Homo sapiens
auuaauuggcucaggug

SEQ ID NO: 2322 - RNA, 17 nt, Homo sapiens
uggcucagguggauuug

SEQ ID NO: 2323 - RNA, 17 nt, Homo sapiens
uggauuuggccaaguuu

SEQ ID NO: 2324 - RNA, 17 nt, Homo sapiens
uuggccaaguuuucaaa

SEQ ID NO: 2325 - RNA, 17 nt, Homo sapiens
uuuucaaagcaaaacac

SEQ ID NO: 2326 - RNA, 17 nt, Homo sapiens
agacuuacguuauuaaa

SEQ ID NO: 2327 - RNA, 17 nt, Homo sapiens
uauuaaacguguuaaau

SEQ ID NO: 2328 - RNA, 17 nt, Homo sapiens
uuaaacguguuaaauau

SEQ ID NO: 2329 - RNA, 17 nt, Homo sapiens
acgagaaggcggagcgu

SEQ ID NO: 2330 - RNA, 17 nt, Homo sapiens
aaggcggagcgugaagu

SEQ ID NO: 2331 - RNA, 17 nt, Homo sapiens
ggcggagcgugaaguaa

SEQ ID NO: 2332 - RNA, 17 nt, Homo sapiens
agcgugaaguaaaagca

SEQ ID NO: 2333 - RNA, 17 nt, Homo sapiens
aaguaaaagcauuggca

SEQ ID NO: 2334 - RNA, 17 nt, Homo sapiens
aagcauuggcaaaacuu

SEQ ID NO: 2335 - RNA, 17 nt, Homo sapiens
uugaucauguaaauauu

SEQ ID NO: 2336 - RNA, 17 nt, Homo sapiens
uaaauauuguucacuac

SEQ ID NO: 2337 - RNA, 17 nt, Homo sapiens
cuacaauggcuguuggg

SEQ ID NO: 2338 - RNA, 17 nt, Homo sapiens
caauggcuguugggaug

SEQ ID NO: 2339 - RNA, 17 nt, Homo sapiens
ugagaccagugaugauu

SEQ ID NO: 2340 - RNA, 17 nt, Homo sapiens
ucuugagagcagugauu

SEQ ID NO: 2341 - RNA, 17 nt, Homo sapiens
ugagagcagugauuaug

SEQ ID NO: 2342 - RNA, 17 nt, Homo sapiens
ugagaacagcaaaaaua

SEQ ID NO: 2343 - RNA, 17 nt, Homo sapiens
caaaaauaguucaaggu

SEQ ID NO: 2344 - RNA, 17 nt, Homo sapiens
aguucaaggucaaagac

SEQ ID NO: 2345 - RNA, 17 nt, Homo sapiens
aagacuaagugccuuuu

SEQ ID NO: 2346 - RNA, 17 nt, Homo sapiens
gacuaagugccuuuuca

SEQ ID NO: 2347 - RNA, 17 nt, Homo sapiens
ggaauucugugauaaag

SEQ ID NO: 2348 - RNA, 17 nt, Homo sapiens
aagaagaggcgagaaac

SEQ ID NO: 2349 - RNA, 17 nt, Homo sapiens
uagacaaaguuuuggcu

SEQ ID NO: 2350 - RNA, 17 nt, Homo sapiens
aaguuuuggcuuuggaa

SEQ ID NO: 2351 - RNA, 17 nt, Homo sapiens
caaaagggguggauuau

SEQ ID NO: 2352 - RNA, 17 nt, Homo sapiens
gaucuuaagccaaguaa

SEQ ID NO: 2353 - RNA, 17 nt, Homo sapiens
uaagccaaguaauauau

SEQ ID NO: 2354 - RNA, 17 nt, Homo sapiens
uauucuuaguagauaca

SEQ ID NO: 2355 - RNA, 17 nt, Homo sapiens
caaaacaaguaaagauu

SEQ ID NO: 2356 - RNA, 17 nt, Homo sapiens
uuggacuuguaacaucu

SEQ ID NO: 2357 - RNA, 17 nt, Homo sapiens
gauggaaagcgaacaag

SEQ ID NO: 2358 - RNA, 17 nt, Homo sapiens
aacaaggaguaagggaa

SEQ ID NO: 2359 - RNA, 17 nt, Homo sapiens
ggaacuuugcgauacau

SEQ ID NO: 2360 - RNA, 17 nt, Homo sapiens
auacaugagcccagaac

SEQ ID NO: 2361 - RNA, 17 nt, Homo sapiens
auuucuucgcaagacua

SEQ ID NO: 2362 - RNA, 17 nt, Homo sapiens
gaaaggaaguggaccuc

SEQ ID NO: 2363 - RNA, 17 nt, Homo sapiens
accucuacgcuuugggg

SEQ ID NO: 2364 - RNA, 17 nt, Homo sapiens
gcuuuggggcuaauucu

SEQ ID NO: 2365 - RNA, 17 nt, Homo sapiens
uaauucuugcugaacuu

SEQ ID NO: 2366 - RNA, 17 nt, Homo sapiens
uucuucauguaugugac

SEQ ID NO: 2367 - RNA, 17 nt, Homo sapiens
ucauguaugugacacug

SEQ ID NO: 2368 - RNA, 17 nt, Homo sapiens
gugacacugcuuuugaa

SEQ ID NO: 2369 - RNA, 17 nt, Homo sapiens
acaucaaaguuuuucac

SEQ ID NO: 2370 - RNA, 17 nt, Homo sapiens
acgggauggcaucaucu

SEQ ID NO: 2371 - RNA, 17 nt, Homo sapiens
ccuugacuguguggaag

SEQ ID NO: 2372 - RNA, 17 nt, Homo sapiens
uugacuguguggaagaa

SEQ ID NO: 2373 - RNA, 17 nt, Homo sapiens
gaagaaaagcccagaga

SEQ ID NO: 2374 - RNA, 17 nt, Homo sapiens
acacacauguuagagcc

SEQ ID NO: 2375 - RNA, 17 nt, Homo sapiens
auguuagagcccuucug

SEQ ID NO: 2376 - RNA, 17 nt, Homo sapiens
cugaaaaaguauccugc

SEQ ID NO: 2377 - RNA, 17 nt, Homo sapiens
aguauccugcuucugau

SEQ ID NO: 2378 - RNA, 17 nt, Homo sapiens
ucugauaugcaguuuuc

SEQ ID NO: 2379 - RNA, 17 nt, Homo sapiens
gauaugcaguuuuccuu

SEQ ID NO: 2380 - RNA, 17 nt, Homo sapiens
uaaaaucugcuagggaa

SEQ ID NO: 2381 - RNA, 17 nt, Homo sapiens
auuuuaauguuuccuuu

SEQ ID NO: 2382 - RNA, 17 nt, Homo sapiens
aucuuucugcagaaaca

SEQ ID NO: 2383 - RNA, 17 nt, Homo sapiens
acagaaagguuuucuuc

SEQ ID NO: 2384 - RNA, 17 nt, Homo sapiens
uucuuuuugcuucaaaa

SEQ ID NO: 2385 - RNA, 17 nt, Homo sapiens
uuuuccuggcucaucuc

SEQ ID NO: 2386 - RNA, 17 nt, Homo sapiens
aagacagagucucgcuc

SEQ ID NO: 2387 - RNA, 17 nt, Homo sapiens
agagucucgcucuguug

SEQ ID NO: 2388 - RNA, 17 nt, Homo sapiens
cucgcucuguugcccag

SEQ ID NO: 2389 - RNA, 17 nt, Homo sapiens
gcucuguugcccaggcu

SEQ ID NO: 2390 - RNA, 17 nt, Homo sapiens
uugcccaggcuggagug

SEQ ID NO: 2391 - RNA, 17 nt, Homo sapiens
aggcuggagugcaauga

SEQ ID NO: 2392 - RNA, 17 nt, Homo sapiens
gcuggagugcaaugaca

SEQ ID NO: 2393 - RNA, 17 nt, Homo sapiens
augacacagucuuggcu

SEQ ID NO: 2394 - RNA, 17 nt, Homo sapiens
cagucuuggcucacugc

SEQ ID NO: 2395 - RNA, 17 nt, Homo sapiens
ggcucacugcaacuucu

SEQ ID NO: 2396 - RNA, 17 nt, Homo sapiens
caacuucugccucuugg

SEQ ID NO: 2397 - RNA, 17 nt, Homo sapiens
ccucuuggguucaagug

SEQ ID NO: 2398 - RNA, 17 nt, Homo sapiens
ggguucaagugauucuc

SEQ ID NO: 2399 - RNA, 17 nt, Homo sapiens
auucuccugccucagcc

SEQ ID NO: 2400 - RNA, 17 nt, Homo sapiens
cugccucagccuccuga

SEQ ID NO: 2401 - RNA, 17 nt, Homo sapiens
ccuccugaguagcugga

SEQ ID NO: 2402 - RNA, 17 nt, Homo sapiens
ccugaguagcuggauua

SEQ ID NO: 2403 - RNA, 17 nt, Homo sapiens
gauuacaggcaugugcc

SEQ ID NO: 2404 - RNA, 17 nt, Homo sapiens
acaggcaugugccaccc

SEQ ID NO: 2405 - RNA, 17 nt, Homo sapiens
aggcaugugccacccac

SEQ ID NO: 2406 - RNA, 17 nt, Homo sapiens
uaauuuuuguguuuuua

SEQ ID NO: 2407 - RNA, 17 nt, Homo sapiens
auuuuuguguuuuuaau

SEQ ID NO: 2408 - RNA, 17 nt, Homo sapiens
aagacaggguuucacca

SEQ ID NO: 2409 - RNA, 17 nt, Homo sapiens
uucaccauguuggccag

SEQ ID NO: 2410 - RNA, 17 nt, Homo sapiens
ccauguuggccaggcug

SEQ ID NO: 2411 - RNA, 17 nt, Homo sapiens
uuggccaggcuggucuc

SEQ ID NO: 2412 - RNA, 17 nt, Homo sapiens
ccaggcuggucucaaac

SEQ ID NO: 2413 - RNA, 17 nt, Homo sapiens
gaccucaaguaauccac

SEQ ID NO: 2414 - RNA, 17 nt, Homo sapiens
auccaccugccucggcc

SEQ ID NO: 2415 - RNA, 17 nt, Homo sapiens
cugccucggccucccaa

SEQ ID NO: 2416 - RNA, 17 nt, Homo sapiens
cucccaaagugcuggga

SEQ ID NO: 2417 - RNA, 17 nt, Homo sapiens
cccaaagugcugggauu

SEQ ID NO: 2418 - RNA, 17 nt, Homo sapiens
agggaugagccaccgcg

SEQ ID NO: 2419 - RNA, 17 nt, Homo sapiens
gagccaccgcgcccagc

SEQ ID NO: 2420 - RNA, 17 nt, Homo sapiens
gccaccgcgcccagccu

SEQ ID NO: 2421 - RNA, 17 nt, Homo sapiens
cgcgcccagccucaucu

SEQ ID NO: 2422 - RNA, 17 nt, Homo sapiens
aucucuuuguucuaaag

SEQ ID NO: 2423 - RNA, 17 nt, Homo sapiens
uuucuaccgcuuuuagg

SEQ ID NO: 2424 - RNA, 17 nt, Homo sapiens
gcuuuuaggccaaaaaa

SEQ ID NO: 2425 - RNA, 17 nt, Homo sapiens
aaaaaaauguaagaucg

SEQ ID NO: 2426 - RNA, 17 nt, Homo sapiens
guaagaucguucucugc

SEQ ID NO: 2427 - RNA, 17 nt, Homo sapiens
cguucucugccucacau

SEQ ID NO: 2428 - RNA, 17 nt, Homo sapiens
cucacauagcuuacaag

SEQ ID NO: 2429 - RNA, 17 nt, Homo sapiens
gcuuacaagccagcugg

SEQ ID NO: 2430 - RNA, 17 nt, Homo sapiens
acaagccagcuggagaa

SEQ ID NO: 2431 - RNA, 17 nt, Homo sapiens
gaaauaugguacucauu

SEQ ID NO: 2432 - RNA, 17 nt, Homo sapiens
aaaaaaaagugauguac

SEQ ID NO: 2433 - RNA, 17 nt, Homo sapiens
cggcggcggcgcaguuu

SEQ ID NO: 2434 - RNA, 17 nt, Homo sapiens
gcggcggcgcaguuugc

SEQ ID NO: 2435 - RNA, 17 nt, Homo sapiens
gcggcgcaguuugcuca

SEQ ID NO: 2436 - RNA, 17 nt, Homo sapiens
cgcaguuugcucauacu

SEQ ID NO: 2437 - RNA, 17 nt, Homo sapiens
cauacuuugugacuugc

SEQ ID NO: 2438 - RNA, 17 nt, Homo sapiens
ugugacuugcggucaca

SEQ ID NO: 2439 - RNA, 17 nt, Homo sapiens
gacuugcggucacagug

SEQ ID NO: 2440 - RNA, 17 nt, Homo sapiens
cggucacaguggcauuc

SEQ ID NO: 2441 - RNA, 17 nt, Homo sapiens
ucacaguggcauucagc

SEQ ID NO: 2442 - RNA, 17 nt, Homo sapiens
ggcauucagcuccacac

SEQ ID NO: 2443 - RNA, 17 nt, Homo sapiens
cacacuugguagaacca

SEQ ID NO: 2444 - RNA, 17 nt, Homo sapiens
aaccacaggcacgacaa

SEQ ID NO: 2445 - RNA, 17 nt, Homo sapiens
cacgacaagcauagaaa

SEQ ID NO: 2446 - RNA, 17 nt, Homo sapiens
ucaucgaggcaucgagg

SEQ ID NO: 2447 - RNA, 17 nt, Homo sapiens
gcaucgagguccauccc

SEQ ID NO: 2448 - RNA, 17 nt, Homo sapiens
agacccuggcuaucaua

SEQ ID NO: 2449 - RNA, 17 nt, Homo sapiens
agaccuuagucuucgcu

SEQ ID NO: 2450 - RNA, 17 nt, Homo sapiens
uagucuucgcugguaua

SEQ ID NO: 2451 - RNA, 17 nt, Homo sapiens
cuucgcugguauacucg

SEQ ID NO: 2452 - RNA, 17 nt, Homo sapiens
guauacucgcugucugu

SEQ ID NO: 2453 - RNA, 17 nt, Homo sapiens
uacucgcugucugucaa

SEQ ID NO: 2454 - RNA, 17 nt, Homo sapiens
cgcugucugucaaccag

SEQ ID NO: 2455 - RNA, 17 nt, Homo sapiens
gucaaccagcgguugac

SEQ ID NO: 2456 - RNA, 17 nt, Homo sapiens
aaccagcgguugacuuu

SEQ ID NO: 2457 - RNA, 17 nt, Homo sapiens
uuuuuuaagccuucuuu

SEQ ID NO: 2458 - RNA, 17 nt, Homo sapiens
uuuuaccaguuucugga

SEQ ID NO: 2459 - RNA, 17 nt, Homo sapiens
uuucuggagcaaauuca

SEQ ID NO: 2460 - RNA, 17 nt, Homo sapiens
caaauucaguuugccuu

SEQ ID NO: 2461 - RNA, 17 nt, Homo sapiens
uucaguuugccuuccug

SEQ ID NO: 2462 - RNA, 17 nt, Homo sapiens
cuggauuuguaaauugu

SEQ ID NO: 2463 - RNA, 17 nt, Homo sapiens
uguaaauuguaaugacc

SEQ ID NO: 2464 - RNA, 17 nt, Homo sapiens
aaacuuuagcaguucuu

SEQ ID NO: 2465 - RNA, 17 nt, Homo sapiens
cuuuagcaguucuucca

SEQ ID NO: 2466 - RNA, 17 nt, Homo sapiens
ugacucagguuugcuuc

SEQ ID NO: 2467 - RNA, 17 nt, Homo sapiens
ucagguuugcuucucug

SEQ ID NO: 2468 - RNA, 17 nt, Homo sapiens
cuucucuggcggucuuc

SEQ ID NO: 2469 - RNA, 17 nt, Homo sapiens
cucuggcggucuucaga

SEQ ID NO: 2470 - RNA, 17 nt, Homo sapiens
acacuuccgugauuauc

SEQ ID NO: 2471 - RNA, 17 nt, Homo sapiens
gauuaucugcgugcauu

SEQ ID NO: 2472 - RNA, 17 nt, Homo sapiens
uuaucugcgugcauuuu

SEQ ID NO: 2473 - RNA, 17 nt, Homo sapiens
aucugcgugcauuuugg

SEQ ID NO: 2474 - RNA, 17 nt, Homo sapiens
uggacaaagcuuccaac

SEQ ID NO: 2475 - RNA, 17 nt, Homo sapiens
aagaaauggcuggugau

SEQ ID NO: 2476 - RNA, 17 nt, Homo sapiens
aauggcuggugaucuuu

SEQ ID NO: 2477 - RNA, 17 nt, Homo sapiens
aucuuucagcagguuuc

SEQ ID NO: 2478 - RNA, 17 nt, Homo sapiens
uucagcagguuucuuca

SEQ ID NO: 2479 - RNA, 17 nt, Homo sapiens
uacauaccgucagaagc

SEQ ID NO: 2480 - RNA, 37 nt, Artificial Sequence
  Description of Artificial Sequence:  Enzymatic Nucleic Acid
cugcgccggccgaaaggcgagugaggucucgccgccg

SEQ ID NO: 2481 - RNA, 37 nt, Artificial Sequence
  Description of Artificial Sequence:  Enzymatic Nucleic Acid
acucccuggccgaaaggcgagugaggucuuucugacg

SEQ ID NO: 2482 - RNA, 37 nt, Artificial Sequence
  Description of Artificial Sequence:  Enzymatic Nucleic Acid
aaguacuagccgaaaggcgagugaggucuucccugcu

SEQ ID NO: 2483 - RNA, 37 nt, Artificial Sequence
  Description of Artificial Sequence:  Enzymatic Nucleic Acid
uuuaaguagccgaaaggcgagugaggucuuacucccu

SEQ ID NO: 2484 - RNA, 37 nt, Artificial Sequence
  Description of Artificial Sequence:  Enzymatic Nucleic Acid
gaauuagggccgaaaggcgagugaggucuaguucuug

SEQ ID NO: 2485 - RNA, 37 nt, Artificial Sequence
  Description of Artificial Sequence:  Enzymatic Nucleic Acid
aauguaaagccgaaaggcgagugaggucucuccuauc

SEQ ID NO: 2486 - RNA, 37 nt, Artificial Sequence
  Description of Artificial Sequence:  Enzymatic Nucleic Acid
uauuauaagccgaaaggcgagugaggucuuugaaaug

SEQ ID NO: 2487 - RNA, 37 nt, Artificial Sequence
  Description of Artificial Sequence:  Enzymatic Nucleic Acid
uaccuucagccgaaaggcgagugaggucucuucugga

SEQ ID NO: 2488 - RNA, 37 nt, Artificial Sequence
  Description of Artificial Sequence:  Enzymatic Nucleic Acid
uugaucuagccgaaaggcgagugaggucucuucaccu

SEQ ID NO: 2489 - RNA, 37 nt, Artificial Sequence
  Description of Artificial Sequence:  Enzymatic Nucleic Acid
auuuuuuggccgaaaggcgagugaggucuuuccuucu

SEQ ID NO: 2490 - RNA, 37 nt, Artificial Sequence
  Description of Artificial Sequence:  Enzymatic Nucleic Acid
ggcugcgggccgaaaggcgagugaggucuauuuuuug

SEQ ID NO: 2491 - RNA, 37 nt, Artificial Sequence
  Description of Artificial Sequence:  Enzymatic Nucleic Acid
uuuggcuggccgaaaggcgagugaggucuggcauuuu

SEQ ID NO: 2492 - RNA, 37 nt, Artificial Sequence
  Description of Artificial Sequence:  Enzymatic Nucleic Acid
uaauuugggccgaaaggcgagugaggucuugcggcau

SEQ ID NO: 2493 - RNA, 37 nt, Artificial Sequence
  Description of Artificial Sequence:  Enzymatic Nucleic Acid
cucaacaggccgaaaggcgagugaggucuuaauuugg

SEQ ID NO: 2494 - RNA, 37 nt, Artificial Sequence
  Description of Artificial Sequence:  Enzymatic Nucleic Acid
uaucucaagccgaaaggcgagugaggucuagcuaauu

SEQ ID NO: 2495 - RNA, 37 nt, Artificial Sequence
  Description of Artificial Sequence:  Enzymatic Nucleic Acid
acuaacuggccgaaaggcgagugaggucucuucuuuu

SEQ ID NO: 2496 - RNA, 37 nt, Artificial Sequence
  Description of Artificial Sequence:  Enzymatic Nucleic Acid
aggacuaagccgaaaggcgagugaggucuugccuucu

SEQ ID NO: 2497 - RNA, 37 nt, Artificial Sequence
  Description of Artificial Sequence:  Enzymatic Nucleic Acid
auaaaggagccgaaaggcgagugaggucuuaacugcc

SEQ ID NO: 2498 - RNA, 37 nt, Artificial Sequence
  Description of Artificial Sequence:  Enzymatic Nucleic Acid
ugauaagggccgaaaggcgagugaggucucuauguaa

SEQ ID NO: 2499 - RNA, 37 nt, Artificial Sequence
  Description of Artificial Sequence:  Enzymatic Nucleic Acid
cuucuggggccgaaaggcgagugaggucuaauucuau

SEQ ID NO: 2500 - RNA, 37 nt, Artificial Sequence
  Description of Artificial Sequence:  Enzymatic Nucleic Acid
auaauuuagccgaaaggcgagugaggucuaguuaguc

SEQ ID NO: 2501 - RNA, 37 nt, Artificial Sequence
  Description of Artificial Sequence:  Enzymatic Nucleic Acid
gaugcacagccgaaaggcgagugaggucuuguucaua

SEQ ID NO: 2502 - RNA, 37 nt, Artificial Sequence
  Description of Artificial Sequence:  Enzymatic Nucleic Acid
ccgaugcagccgaaaggcgagugaggucuacuguuca

SEQ ID NO: 2503 - RNA, 37 nt, Artificial Sequence
  Description of Artificial Sequence:  Enzymatic Nucleic Acid
ccccgauggccgaaaggcgagugaggucuacacuguu

SEQ ID NO: 2504 - RNA, 37 nt, Artificial Sequence
  Description of Artificial Sequence:  Enzymatic Nucleic Acid
cccaugcagccgaaaggcgagugaggucuccccgaug

SEQ ID NO: 2505 - RNA, 37 nt, Artificial Sequence
  Description of Artificial Sequence:  Enzymatic Nucleic Acid
ggcccauggccgaaaggcgagugaggucuacccccga

SEQ ID NO: 2506 - RNA, 37 nt, Artificial Sequence
  Description of Artificial Sequence:  Enzymatic Nucleic Acid
ccuucugggccgaaaggcgagugaggucuccaugcac

SEQ ID NO: 2507 - RNA, 37 nt, Artificial Sequence
  Description of Artificial Sequence:  Enzymatic Nucleic Acid
ccauuuuggccgaaaggcgagugaggucuauuuauaa

SEQ ID NO: 2508 - RNA, 37 nt, Artificial Sequence
  Description of Artificial Sequence:  Enzymatic Nucleic Acid
uaccaauagccgaaaggcgagugaggucuuauauucu

SEQ ID NO: 2509 - RNA, 37 nt, Artificial Sequence
  Description of Artificial Sequence:  Enzymatic Nucleic Acid
aaccuguagccgaaaggcgagugaggucucaauacua

SEQ ID NO: 2510 - RNA, 37 nt, Artificial Sequence
  Description of Artificial Sequence:  Enzymatic Nucleic Acid
uaguagaagccgaaaggcgagugaggucucuguacca

SEQ ID NO: 2511 - RNA, 37 nt, Artificial Sequence
  Description of Artificial Sequence:  Enzymatic Nucleic Acid
uuguuuuggccgaaaggcgagugaggucuuuccuguu

SEQ ID NO: 2512 - RNA, 37 nt, Artificial Sequence
  Description of Artificial Sequence:  Enzymatic Nucleic Acid
uuuagcgggccgaaaggcgagugaggucucaauuguu

SEQ ID NO: 2513 - RNA, 37 nt, Artificial Sequence
  Description of Artificial Sequence:  Enzymatic Nucleic Acid
aaguuuaggccgaaaggcgagugaggucuggccaauu

SEQ ID NO: 2514 - RNA, 37 nt, Artificial Sequence
  Description of Artificial Sequence:  Enzymatic Nucleic Acid
aagauauggccgaaaggcgagugaggucuaaguuuag

SEQ ID NO: 2515 - RNA, 37 nt, Artificial Sequence
  Description of Artificial Sequence:  Enzymatic Nucleic Acid
agauuucagccgaaaggcgagugaggucuugagguuu

SEQ ID NO: 2516 - RNA, 37 nt, Artificial Sequence
  Description of Artificial Sequence:  Enzymatic Nucleic Acid
ccagaggagccgaaaggcgagugaggucuagguaguc

SEQ ID NO: 2517 - RNA, 37 nt, Artificial Sequence
  Description of Artificial Sequence:  Enzymatic Nucleic Acid
caaaagaagccgaaaggcgagugaggucucagaggac

SEQ ID NO: 2518 - RNA, 37 nt, Artificial Sequence
  Description of Artificial Sequence:  Enzymatic Nucleic Acid
cguaguaggccgaaaggcgagugaggucuaaaagaac

SEQ ID NO: 2519 - RNA, 37 nt, Artificial Sequence
  Description of Artificial Sequence:  Enzymatic Nucleic Acid
gacucacagccgaaaggcgagugaggucuguaguagc

SEQ ID NO: 2520 - RNA, 37 nt, Artificial Sequence
  Description of Artificial Sequence:  Enzymatic Nucleic Acid
gggacucagccgaaaggcgagugaggucuacguagua

SEQ ID NO: 2521 - RNA, 37 nt, Artificial Sequence
  Description of Artificial Sequence:  Enzymatic Nucleic Acid
cuuugggagccgaaaggcgagugaggucuucacacgu

SEQ ID NO: 2522 - RNA, 37 nt, Artificial Sequence
  Description of Artificial Sequence:  Enzymatic Nucleic Acid
aagaguuggccgaaaggcgagugaggucuuuugggac

SEQ ID NO: 2523 - RNA, 37 nt, Artificial Sequence
  Description of Artificial Sequence:  Enzymatic Nucleic Acid
gcuggucagccgaaaggcgagugaggucuuaaagagu

SEQ ID NO: 2524 - RNA, 37 nt, Artificial Sequence
  Description of Artificial Sequence:  Enzymatic Nucleic Acid
cgaguguggccgaaaggcgagugaggucuuggucacu

SEQ ID NO: 2525 - RNA, 37 nt, Artificial Sequence
  Description of Artificial Sequence:  Enzymatic Nucleic Acid
uucagaaggccgaaaggcgagugaggucugagugugc

SEQ ID NO: 2526 - RNA, 37 nt, Artificial Sequence
  Description of Artificial Sequence:  Enzymatic Nucleic Acid
agaagucagccgaaaggcgagugaggucucuucagau

SEQ ID NO: 2527 - RNA, 37 nt, Artificial Sequence
  Description of Artificial Sequence:  Enzymatic Nucleic Acid
uguaucuggccgaaaggcgagugaggucuugagaagu

SEQ ID NO: 2528 - RNA, 37 nt, Artificial Sequence
  Description of Artificial Sequence:  Enzymatic Nucleic Acid
aacugucagccgaaaggcgagugaggucuuguuagaa

SEQ ID NO: 2529 - RNA, 37 nt, Artificial Sequence
  Description of Artificial Sequence:  Enzymatic Nucleic Acid
uguuuaaagccgaaaggcgagugaggucuugucacug

SEQ ID NO: 2530 - RNA, 37 nt, Artificial Sequence
  Description of Artificial Sequence:  Enzymatic Nucleic Acid
acgaagaagccgaaaggcgagugaggucuuguuuaaa

SEQ ID NO: 2531 - RNA, 37 nt, Artificial Sequence
  Description of Artificial Sequence:  Enzymatic Nucleic Acid
auaagcaagccgaaaggcgagugaggucugaagaacu

SEQ ID NO: 2532 - RNA, 37 nt, Artificial Sequence
  Description of Artificial Sequence:  Enzymatic Nucleic Acid
uucauaaggccgaaaggcgagugaggucuaacgaaga

SEQ ID NO: 2533 - RNA, 37 nt, Artificial Sequence
  Description of Artificial Sequence:  Enzymatic Nucleic Acid
uucugagagccgaaaggcgagugaggucucauucaua

SEQ ID NO: 2534 - RNA, 37 nt, Artificial Sequence
  Description of Artificial Sequence:  Enzymatic Nucleic Acid
ucuuuuuggccgaaaggcgagugaggucucuuccuuu

SEQ ID NO: 2535 - RNA, 37 nt, Artificial Sequence
  Description of Artificial Sequence:  Enzymatic Nucleic Acid
ucuggguggccgaaaggcgagugaggucucaaagauc

SEQ ID NO: 2536 - RNA, 37 nt, Artificial Sequence
  Description of Artificial Sequence:  Enzymatic Nucleic Acid
acaguauagccgaaaggcgagugaggucuuuuguuuc

SEQ ID NO: 2537 - RNA, 37 nt, Artificial Sequence
  Description of Artificial Sequence:  Enzymatic Nucleic Acid
cuuguccagccgaaaggcgagugaggucuaguauacu

SEQ ID NO: 2538 - RNA, 37 nt, Artificial Sequence
  Description of Artificial Sequence:  Enzymatic Nucleic Acid
augccaaagccgaaaggcgagugaggucucucuuguc

SEQ ID NO: 2539 - RNA, 37 nt, Artificial Sequence
  Description of Artificial Sequence:  Enzymatic Nucleic Acid
aauccauggccgaaaggcgagugaggucucaaaccuc

SEQ ID NO: 2540 - RNA, 37 nt, Artificial Sequence
  Description of Artificial Sequence:  Enzymatic Nucleic Acid
caccugaggccgaaaggcgagugaggucucaauuaau

SEQ ID NO: 2541 - RNA, 37 nt, Artificial Sequence
  Description of Artificial Sequence:  Enzymatic Nucleic Acid
caaauccagccgaaaggcgagugaggucucugagcca

SEQ ID NO: 2542 - RNA, 37 nt, Artificial Sequence
  Description of Artificial Sequence:  Enzymatic Nucleic Acid
aaacuugggccgaaaggcgagugaggucucaaaucca

SEQ ID NO: 2543 - RNA, 37 nt, Artificial Sequence
  Description of Artificial Sequence:  Enzymatic Nucleic Acid
uuugaaaagccgaaaggcgagugaggucuuuggccaa

SEQ ID NO: 2544 - RNA, 37 nt, Artificial Sequence
  Description of Artificial Sequence:  Enzymatic Nucleic Acid
guguuuuggccgaaaggcgagugaggucuuuugaaaa

SEQ ID NO: 2545 - RNA, 37 nt, Artificial Sequence
  Description of Artificial Sequence:  Enzymatic Nucleic Acid
uuuaauaagccgaaaggcgagugaggucuguaagucu

SEQ ID NO: 2546 - RNA, 37 nt, Artificial Sequence
  Description of Artificial Sequence:  Enzymatic Nucleic Acid
auuuaacagccgaaaggcgagugaggucuguuuaaua

SEQ ID NO: 2547 - RNA, 37 nt, Artificial Sequence
  Description of Artificial Sequence:  Enzymatic Nucleic Acid
auauuuaagccgaaaggcgagugaggucuacguuuaa

SEQ ID NO: 2548 - RNA, 37 nt, Artificial Sequence
  Description of Artificial Sequence:  Enzymatic Nucleic Acid
acgcuccggccgaaaggcgagugaggucucuucucgu

SEQ ID NO: 2549 - RNA, 37 nt, Artificial Sequence
  Description of Artificial Sequence:  Enzymatic Nucleic Acid
acuucacggccgaaaggcgagugaggucuuccgccuu

SEQ ID NO: 2550 - RNA, 37 nt, Artificial Sequence
  Description of Artificial Sequence:  Enzymatic Nucleic Acid
uuacuucagccgaaaggcgagugaggucugcuccgcc

SEQ ID NO: 2551 - RNA, 37 nt, Artificial Sequence
  Description of Artificial Sequence:  Enzymatic Nucleic Acid
ugcuuuuagccgaaaggcgagugaggucuuucacgcu

SEQ ID NO: 2552 - RNA, 37 nt, Artificial Sequence
  Description of Artificial Sequence:  Enzymatic Nucleic Acid
ugccaauggccgaaaggcgagugaggucuuuuuacuu

SEQ ID NO: 2553 - RNA, 37 nt, Artificial Sequence
  Description of Artificial Sequence:  Enzymatic Nucleic Acid
aaguuuuggccgaaaggcgagugaggucucaaugcuu

SEQ ID NO: 2554 - RNA, 37 nt, Artificial Sequence
  Description of Artificial Sequence:  Enzymatic Nucleic Acid
aauauuuagccgaaaggcgagugaggucuaugaucaa

SEQ ID NO: 2555 - RNA, 37 nt, Artificial Sequence
  Description of Artificial Sequence:  Enzymatic Nucleic Acid
guagugaagccgaaaggcgagugaggucuaauauuua

SEQ ID NO: 2556 - RNA, 37 nt, Artificial Sequence
  Description of Artificial Sequence:  Enzymatic Nucleic Acid
cccaacaggccgaaaggcgagugaggucucauuguag

SEQ ID NO: 2557 - RNA, 37 nt, Artificial Sequence
  Description of Artificial Sequence:  Enzymatic Nucleic Acid
caucccaagccgaaaggcgagugaggucuagccauug

SEQ ID NO: 2558 - RNA, 37 nt, Artificial Sequence
  Description of Artificial Sequence:  Enzymatic Nucleic Acid
aaucaucagccgaaaggcgagugaggucuuggucuca

SEQ ID NO: 2559 - RNA, 37 nt, Artificial Sequence
  Description of Artificial Sequence:  Enzymatic Nucleic Acid
aaucacuggccgaaaggcgagugaggucuucucaaga

SEQ ID NO: 2560 - RNA, 37 nt, Artificial Sequence
  Description of Artificial Sequence:  Enzymatic Nucleic Acid
cauaaucagccgaaaggcgagugaggucuugcucuca

SEQ ID NO: 2561 - RNA, 37 nt, Artificial Sequence
  Description of Artificial Sequence:  Enzymatic Nucleic Acid
uauuuuuggccgaaaggcgagugaggucuuguucuca

SEQ ID NO: 2562 - RNA, 37 nt, Artificial Sequence
  Description of Artificial Sequence:  Enzymatic Nucleic Acid
accuugaagccgaaaggcgagugaggucuuauuuuug

SEQ ID NO: 2563 - RNA, 37 nt, Artificial Sequence
  Description of Artificial Sequence:  Enzymatic Nucleic Acid
gucuuugagccgaaaggcgagugaggucucuugaacu

SEQ ID NO: 2564 - RNA, 37 nt, Artificial Sequence
  Description of Artificial Sequence:  Enzymatic Nucleic Acid
aaaaggcagccgaaaggcgagugaggucuuuagucuu

SEQ ID NO: 2565 - RNA, 37 nt, Artificial Sequence
  Description of Artificial Sequence:  Enzymatic Nucleic Acid
ugaaaagggccgaaaggcgagugaggucuacuuaguc

SEQ ID NO: 2566 - RNA, 37 nt, Artificial Sequence
  Description of Artificial Sequence:  Enzymatic Nucleic Acid
cuuuaucagccgaaaggcgagugaggucuagaauucc

SEQ ID NO: 2567 - RNA, 37 nt, Artificial Sequence
  Description of Artificial Sequence:  Enzymatic Nucleic Acid
guuucucggccgaaaggcgagugaggucucucuucuu

SEQ ID NO: 2568 - RNA, 37 nt, Artificial Sequence
  Description of Artificial Sequence:  Enzymatic Nucleic Acid
agccaaaagccgaaaggcgagugaggucuuuugucua

SEQ ID NO: 2569 - RNA, 37 nt, Artificial Sequence
  Description of Artificial Sequence:  Enzymatic Nucleic Acid
uuccaaaggccgaaaggcgagugaggucucaaaacuu

SEQ ID NO: 2570 - RNA, 37 nt, Artificial Sequence
  Description of Artificial Sequence:  Enzymatic Nucleic Acid
auaauccagccgaaaggcgagugaggucucccuuuug

SEQ ID NO: 2571 - RNA, 37 nt, Artificial Sequence
  Description of Artificial Sequence:  Enzymatic Nucleic Acid
uuacuugggccgaaaggcgagugaggucuuuaagauc

SEQ ID NO: 2572 - RNA, 37 nt, Artificial Sequence
  Description of Artificial Sequence:  Enzymatic Nucleic Acid
auauauuagccgaaaggcgagugaggucuuuggcuua

SEQ ID NO: 2573 - RNA, 37 nt, Artificial Sequence
  Description of Artificial Sequence:  Enzymatic Nucleic Acid
uguaucuagccgaaaggcgagugaggucuuaagaaua

SEQ ID NO: 2574 - RNA, 37 nt, Artificial Sequence
  Description of Artificial Sequence:  Enzymatic Nucleic Acid
aaucuuuagccgaaaggcgagugaggucuuuguuuug

SEQ ID NO: 2575 - RNA, 37 nt, Artificial Sequence
  Description of Artificial Sequence:  Enzymatic Nucleic Acid
agauguuagccgaaaggcgagugaggucuaaguccaa

SEQ ID NO: 2576 - RNA, 37 nt, Artificial Sequence
  Description of Artificial Sequence:  Enzymatic Nucleic Acid
cuuguucggccgaaaggcgagugaggucuuuuccauc

SEQ ID NO: 2577 - RNA, 37 nt, Artificial Sequence
  Description of Artificial Sequence:  Enzymatic Nucleic Acid
uucccuuagccgaaaggcgagugaggucuuccuuguu

SEQ ID NO: 2578 - RNA, 37 nt, Artificial Sequence
  Description of Artificial Sequence:  Enzymatic Nucleic Acid
auguaucggccgaaaggcgagugaggucuaaaguucc

SEQ ID NO: 2579 - RNA, 37 nt, Artificial Sequence
  Description of Artificial Sequence:  Enzymatic Nucleic Acid
guucuggggccgaaaggcgagugaggucuucauguau

SEQ ID NO: 2580 - RNA, 37 nt, Artificial Sequence
  Description of Artificial Sequence:  Enzymatic Nucleic Acid
uagucuuggccgaaaggcgagugaggucugaagaaau

SEQ ID NO: 2581 - RNA, 37 nt, Artificial Sequence
  Description of Artificial Sequence:  Enzymatic Nucleic Acid
gagguccagccgaaaggcgagugaggucuuuccuuuc

SEQ ID NO: 2582 - RNA, 37 nt, Artificial Sequence
  Description of Artificial Sequence:  Enzymatic Nucleic Acid
ccccaaaggccgaaaggcgagugaggucuguagaggu

SEQ ID NO: 2583 - RNA, 37 nt, Artificial Sequence
  Description of Artificial Sequence:  Enzymatic Nucleic Acid
agaauuaggccgaaaggcgagugaggucucccaaagc

SEQ ID NO: 2584 - RNA, 37 nt, Artificial Sequence
  Description of Artificial Sequence:  Enzymatic Nucleic Acid
aaguucaggccgaaaggcgagugaggucuaagaauua

SEQ ID NO: 2585 - RNA, 37 nt, Artificial Sequence
  Description of Artificial Sequence:  Enzymatic Nucleic Acid
gucacauagccgaaaggcgagugaggucuaugaagaa

SEQ ID NO: 2586 - RNA, 37 nt, Artificial Sequence
  Description of Artificial Sequence:  Enzymatic Nucleic Acid
cagugucagccgaaaggcgagugaggucuauacauga

SEQ ID NO: 2587 - RNA, 37 nt, Artificial Sequence
  Description of Artificial Sequence:  Enzymatic Nucleic Acid
uucaaaaggccgaaaggcgagugaggucuagugucac

SEQ ID NO: 2588 - RNA, 37 nt, Artificial Sequence
  Description of Artificial Sequence:  Enzymatic Nucleic Acid
gugaaaaagccgaaaggcgagugaggucuuuugaugu

SEQ ID NO: 2589 - RNA, 37 nt, Artificial Sequence
  Description of Artificial Sequence:  Enzymatic Nucleic Acid
agaugauggccgaaaggcgagugaggucucaucccgu

SEQ ID NO: 2590 - RNA, 37 nt, Artificial Sequence
  Description of Artificial Sequence:  Enzymatic Nucleic Acid
cuuccacagccgaaaggcgagugaggucuagucaagg

SEQ ID NO: 2591 - RNA, 37 nt, Artificial Sequence
  Description of Artificial Sequence:  Enzymatic Nucleic Acid
uucuuccagccgaaaggcgagugaggucuacagucaa

SEQ ID NO: 2592 - RNA, 37 nt, Artificial Sequence
  Description of Artificial Sequence:  Enzymatic Nucleic Acid
ucucuggggccgaaaggcgagugaggucuuuuucuuc

SEQ ID NO: 2593 - RNA, 37 nt, Artificial Sequence
  Description of Artificial Sequence:  Enzymatic Nucleic Acid
ggcucuaagccgaaaggcgagugaggucuaugugugu

SEQ ID NO: 2594 - RNA, 37 nt, Artificial Sequence
  Description of Artificial Sequence:  Enzymatic Nucleic Acid
cagaaggggccgaaaggcgagugaggucuucuaacau

SEQ ID NO: 2595 - RNA, 37 nt, Artificial Sequence
  Description of Artificial Sequence:  Enzymatic Nucleic Acid
gcaggauagccgaaaggcgagugaggucuuuuuucag

SEQ ID NO: 2596 - RNA, 37 nt, Artificial Sequence
  Description of Artificial Sequence:  Enzymatic Nucleic Acid
aucagaaggccgaaaggcgagugaggucuaggauacu

SEQ ID NO: 2597 - RNA, 37 nt, Artificial Sequence
  Description of Artificial Sequence:  Enzymatic Nucleic Acid
gaaaacuggccgaaaggcgagugaggucuauaucaga

SEQ ID NO: 2598 - RNA, 37 nt, Artificial Sequence
  Description of Artificial Sequence:  Enzymatic Nucleic Acid
aaggaaaagccgaaaggcgagugaggucuugcauauc

SEQ ID NO: 2599 - RNA, 37 nt, Artificial Sequence
  Description of Artificial Sequence:  Enzymatic Nucleic Acid
uucccuaggccgaaaggcgagugaggucuagauuuua

SEQ ID NO: 2600 - RNA, 37 nt, Artificial Sequence
  Description of Artificial Sequence:  Enzymatic Nucleic Acid
aaaggaaagccgaaaggcgagugaggucuauuaaaau

SEQ ID NO: 2601 - RNA, 37 nt, Artificial Sequence
  Description of Artificial Sequence:  Enzymatic Nucleic Acid
uguuucuggccgaaaggcgagugaggucuagaaagau

SEQ ID NO: 2602 - RNA, 37 nt, Artificial Sequence
  Description of Artificial Sequence:  Enzymatic Nucleic Acid
gaagaaaagccgaaaggcgagugaggucucuuucugu

SEQ ID NO: 2603 - RNA, 37 nt, Artificial Sequence
  Description of Artificial Sequence:  Enzymatic Nucleic Acid
uuuugaaggccgaaaggcgagugaggucuaaaaagaa

SEQ ID NO: 2604 - RNA, 37 nt, Artificial Sequence
  Description of Artificial Sequence:  Enzymatic Nucleic Acid
gagaugaggccgaaaggcgagugaggucucaggaaaa

SEQ ID NO: 2605 - RNA, 37 nt, Artificial Sequence
  Description of Artificial Sequence:  Enzymatic Nucleic Acid
gagcgagagccgaaaggcgagugaggucuucugucuu

SEQ ID NO: 2606 - RNA, 37 nt, Artificial Sequence
  Description of Artificial Sequence:  Enzymatic Nucleic Acid
caacagaggccgaaaggcgagugaggucugagacucu

SEQ ID NO: 2607 - RNA, 37 nt, Artificial Sequence
  Description of Artificial Sequence:  Enzymatic Nucleic Acid
cugggcaagccgaaaggcgagugaggucuagagcgag

SEQ ID NO: 2608 - RNA, 37 nt, Artificial Sequence
  Description of Artificial Sequence:  Enzymatic Nucleic Acid
agccuggggccgaaaggcgagugaggucuaacagagc

SEQ ID NO: 2609 - RNA, 37 nt, Artificial Sequence
  Description of Artificial Sequence:  Enzymatic Nucleic Acid
cacuccaggccgaaaggcgagugaggucucugggcaa

SEQ ID NO: 2610 - RNA, 37 nt, Artificial Sequence
  Description of Artificial Sequence:  Enzymatic Nucleic Acid
ucauugcagccgaaaggcgagugaggucuuccagccu

SEQ ID NO: 2611 - RNA, 37 nt, Artificial Sequence
  Description of Artificial Sequence:  Enzymatic Nucleic Acid
ugucauuggccgaaaggcgagugaggucuacuccagc

SEQ ID NO: 2612 - RNA, 37 nt, Artificial Sequence
  Description of Artificial Sequence:  Enzymatic Nucleic Acid
agccaagagccgaaaggcgagugaggucuugugucau

SEQ ID NO: 2613 - RNA, 37 nt, Artificial Sequence
  Description of Artificial Sequence:  Enzymatic Nucleic Acid
gcagugaggccgaaaggcgagugaggucucaagacug

SEQ ID NO: 2614 - RNA, 37 nt, Artificial Sequence
  Description of Artificial Sequence:  Enzymatic Nucleic Acid
agaaguuggccgaaaggcgagugaggucuagugagcc

SEQ ID NO: 2615 - RNA, 37 nt, Artificial Sequence
  Description of Artificial Sequence:  Enzymatic Nucleic Acid
ccaagagggccgaaaggcgagugaggucuagaaguug

SEQ ID NO: 2616 - RNA, 37 nt, Artificial Sequence
  Description of Artificial Sequence:  Enzymatic Nucleic Acid
cacuugaagccgaaaggcgagugaggucuccaagagg

SEQ ID NO: 2617 - RNA, 37 nt, Artificial Sequence
  Description of Artificial Sequence:  Enzymatic Nucleic Acid
gagaaucagccgaaaggcgagugaggucuuugaaccc

SEQ ID NO: 2618 - RNA, 37 nt, Artificial Sequence
  Description of Artificial Sequence:  Enzymatic Nucleic Acid
ggcugagggccgaaaggcgagugaggucuaggagaau

SEQ ID NO: 2619 - RNA, 37 nt, Artificial Sequence
  Description of Artificial Sequence:  Enzymatic Nucleic Acid
ucaggagggccgaaaggcgagugaggucuugaggcag

SEQ ID NO: 2620 - RNA, 37 nt, Artificial Sequence
  Description of Artificial Sequence:  Enzymatic Nucleic Acid
uccagcuagccgaaaggcgagugaggucuucaggagg

SEQ ID NO: 2621 - RNA, 37 nt, Artificial Sequence
  Description of Artificial Sequence:  Enzymatic Nucleic Acid
uaauccaggccgaaaggcgagugaggucuuacucagg

SEQ ID NO: 2622 - RNA, 37 nt, Artificial Sequence
  Description of Artificial Sequence:  Enzymatic Nucleic Acid
ggcacauggccgaaaggcgagugaggucucuguaauc

SEQ ID NO: 2623 - RNA, 37 nt, Artificial Sequence
  Description of Artificial Sequence:  Enzymatic Nucleic Acid
ggguggcagccgaaaggcgagugaggucuaugccugu

SEQ ID NO: 2624 - RNA, 37 nt, Artificial Sequence
  Description of Artificial Sequence:  Enzymatic Nucleic Acid
gugggugggccgaaaggcgagugaggucuacaugccu

SEQ ID NO: 2625 - RNA, 37 nt, Artificial Sequence
  Description of Artificial Sequence:  Enzymatic Nucleic Acid
uaaaaacagccgaaaggcgagugaggucuaaaaauua

SEQ ID NO: 2626 - RNA, 37 nt, Artificial Sequence
  Description of Artificial Sequence:  Enzymatic Nucleic Acid
auuaaaaagccgaaaggcgagugaggucuacaaaaau

SEQ ID NO: 2627 - RNA, 37 nt, Artificial Sequence
  Description of Artificial Sequence:  Enzymatic Nucleic Acid
uggugaaagccgaaaggcgagugaggucuccugucuu

SEQ ID NO: 2628 - RNA, 37 nt, Artificial Sequence
  Description of Artificial Sequence:  Enzymatic Nucleic Acid
cuggccaagccgaaaggcgagugaggucuauggugaa

SEQ ID NO: 2629 - RNA, 37 nt, Artificial Sequence
  Description of Artificial Sequence:  Enzymatic Nucleic Acid
cagccugggccgaaaggcgagugaggucucaacaugg

SEQ ID NO: 2630 - RNA, 37 nt, Artificial Sequence
  Description of Artificial Sequence:  Enzymatic Nucleic Acid
gagaccaggccgaaaggcgagugaggucucuggccaa

SEQ ID NO: 2631 - RNA, 37 nt, Artificial Sequence
  Description of Artificial Sequence:  Enzymatic Nucleic Acid
guuugagagccgaaaggcgagugaggucucagccugg

SEQ ID NO: 2632 - RNA, 37 nt, Artificial Sequence
  Description of Artificial Sequence:  Enzymatic Nucleic Acid
guggauuagccgaaaggcgagugaggucuuugagguc

SEQ ID NO: 2633 - RNA, 37 nt, Artificial Sequence
  Description of Artificial Sequence:  Enzymatic Nucleic Acid
ggccgagggccgaaaggcgagugaggucuagguggau

SEQ ID NO: 2634 - RNA, 37 nt, Artificial Sequence
  Description of Artificial Sequence:  Enzymatic Nucleic Acid
uugggagggccgaaaggcgagugaggucucgaggcag

SEQ ID NO: 2635 - RNA, 37 nt, Artificial Sequence
  Description of Artificial Sequence:  Enzymatic Nucleic Acid
ucccagcagccgaaaggcgagugaggucuuuugggag

SEQ ID NO: 2636 - RNA, 37 nt, Artificial Sequence
  Description of Artificial Sequence:  Enzymatic Nucleic Acid
aaucccaggccgaaaggcgagugaggucuacuuuggg

SEQ ID NO: 2637 - RNA, 37 nt, Artificial Sequence
  Description of Artificial Sequence:  Enzymatic Nucleic Acid
cgcggugggccgaaaggcgagugaggucuucaucccu

SEQ ID NO: 2638 - RNA, 37 nt, Artificial Sequence
  Description of Artificial Sequence:  Enzymatic Nucleic Acid
gcugggcggccgaaaggcgagugaggucugguggcuc

SEQ ID NO: 2639 - RNA, 37 nt, Artificial Sequence
  Description of Artificial Sequence:  Enzymatic Nucleic Acid
aggcuggggccgaaaggcgagugaggucugcgguggc

SEQ ID NO: 2640 - RNA, 37 nt, Artificial Sequence
  Description of Artificial Sequence:  Enzymatic Nucleic Acid
agaugagggccgaaaggcgagugaggucuugggcgcg

SEQ ID NO: 2641 - RNA, 37 nt, Artificial Sequence
  Description of Artificial Sequence:  Enzymatic Nucleic Acid
cuuuagaagccgaaaggcgagugaggucuaaagagau

SEQ ID NO: 2642 - RNA, 37 nt, Artificial Sequence
  Description of Artificial Sequence:  Enzymatic Nucleic Acid
ccuaaaaggccgaaaggcgagugaggucugguagaaa

SEQ ID NO: 2643 - RNA, 37 nt, Artificial Sequence
  Description of Artificial Sequence:  Enzymatic Nucleic Acid
uuuuuugggccgaaaggcgagugaggucucuaaaagc

SEQ ID NO: 2644 - RNA, 37 nt, Artificial Sequence
  Description of Artificial Sequence:  Enzymatic Nucleic Acid
cgaucuuagccgaaaggcgagugaggucuauuuuuuu

SEQ ID NO: 2645 - RNA, 37 nt, Artificial Sequence
  Description of Artificial Sequence:  Enzymatic Nucleic Acid
gcagagaagccgaaaggcgagugaggucugaucuuac

SEQ ID NO: 2646 - RNA, 37 nt, Artificial Sequence
  Description of Artificial Sequence:  Enzymatic Nucleic Acid
augugagggccgaaaggcgagugaggucuagagaacg

SEQ ID NO: 2647 - RNA, 37 nt, Artificial Sequence
  Description of Artificial Sequence:  Enzymatic Nucleic Acid
cuuguaaggccgaaaggcgagugaggucuuaugugag

SEQ ID NO: 2648 - RNA, 37 nt, Artificial Sequence
  Description of Artificial Sequence:  Enzymatic Nucleic Acid
ccagcugggccgaaaggcgagugaggucuuuguaagc

SEQ ID NO: 2649 - RNA, 37 nt, Artificial Sequence
  Description of Artificial Sequence:  Enzymatic Nucleic Acid
uucuccaggccgaaaggcgagugaggucuuggcuugu

SEQ ID NO: 2650 - RNA, 37 nt, Artificial Sequence
  Description of Artificial Sequence:  Enzymatic Nucleic Acid
aaugaguagccgaaaggcgagugaggucucauauuuc

SEQ ID NO: 2651 - RNA, 37 nt, Artificial Sequence
  Description of Artificial Sequence:  Enzymatic Nucleic Acid
guacaucagccgaaaggcgagugaggucuuuuuuuuu

SEQ ID NO: 2652 - RNA, 37 nt, Artificial Sequence
  Description of Artificial Sequence:  Enzymatic Nucleic Acid
aaacugcggccgaaaggcgagugaggucucgccgccg

SEQ ID NO: 2653 - RNA, 37 nt, Artificial Sequence
  Description of Artificial Sequence:  Enzymatic Nucleic Acid
gcaaacuggccgaaaggcgagugaggucugccgccgc

SEQ ID NO: 2654 - RNA, 37 nt, Artificial Sequence
  Description of Artificial Sequence:  Enzymatic Nucleic Acid
ugagcaaagccgaaaggcgagugaggucuugcgccgc

SEQ ID NO: 2655 - RNA, 37 nt, Artificial Sequence
  Description of Artificial Sequence:  Enzymatic Nucleic Acid
aguaugaggccgaaaggcgagugaggucuaaacugcg

SEQ ID NO: 2656 - RNA, 37 nt, Artificial Sequence
  Description of Artificial Sequence:  Enzymatic Nucleic Acid
gcaagucagccgaaaggcgagugaggucuaaaguaug

SEQ ID NO: 2657 - RNA, 37 nt, Artificial Sequence
  Description of Artificial Sequence:  Enzymatic Nucleic Acid
ugugaccggccgaaaggcgagugaggucuaagucaca

SEQ ID NO: 2658 - RNA, 37 nt, Artificial Sequence
  Description of Artificial Sequence:  Enzymatic Nucleic Acid
cacugugagccgaaaggcgagugaggucucgcaaguc

SEQ ID NO: 2659 - RNA, 37 nt, Artificial Sequence
  Description of Artificial Sequence:  Enzymatic Nucleic Acid
gaaugccagccgaaaggcgagugaggucuugugaccg

SEQ ID NO: 2660 - RNA, 37 nt, Artificial Sequence
  Description of Artificial Sequence:  Enzymatic Nucleic Acid
gcugaauggccgaaaggcgagugaggucucacuguga

SEQ ID NO: 2661 - RNA, 37 nt, Artificial Sequence
  Description of Artificial Sequence:  Enzymatic Nucleic Acid
guguggaggccgaaaggcgagugaggucuugaaugcc

SEQ ID NO: 2662 - RNA, 37 nt, Artificial Sequence
  Description of Artificial Sequence:  Enzymatic Nucleic Acid
ugguucuagccgaaaggcgagugaggucucaagugug

SEQ ID NO: 2663 - RNA, 37 nt, Artificial Sequence
  Description of Artificial Sequence:  Enzymatic Nucleic Acid
uugucguggccgaaaggcgagugaggucucugugguu

SEQ ID NO: 2664 - RNA, 37 nt, Artificial Sequence
  Description of Artificial Sequence:  Enzymatic Nucleic Acid
uuucuauggccgaaaggcgagugaggucuuugucgug

SEQ ID NO: 2665 - RNA, 37 nt, Artificial Sequence
  Description of Artificial Sequence:  Enzymatic Nucleic Acid
ccucgauggccgaaaggcgagugaggucucucgauga

SEQ ID NO: 2666 - RNA, 37 nt, Artificial Sequence
  Description of Artificial Sequence:  Enzymatic Nucleic Acid
gggauggagccgaaaggcgagugaggucucucgaugc

SEQ ID NO: 2667 - RNA, 37 nt, Artificial Sequence
  Description of Artificial Sequence:  Enzymatic Nucleic Acid
uaugauaggccgaaaggcgagugaggucucagggucu

SEQ ID NO: 2668 - RNA, 37 nt, Artificial Sequence
  Description of Artificial Sequence:  Enzymatic Nucleic Acid
agcgaagagccgaaaggcgagugaggucuuaaggucu

SEQ ID NO: 2669 - RNA, 37 nt, Artificial Sequence
  Description of Artificial Sequence:  Enzymatic Nucleic Acid
uauaccaggccgaaaggcgagugaggucugaagacua

SEQ ID NO: 2670 - RNA, 37 nt, Artificial Sequence
  Description of Artificial Sequence:  Enzymatic Nucleic Acid
cgaguauagccgaaaggcgagugaggucucagcgaag

SEQ ID NO: 2671 - RNA, 37 nt, Artificial Sequence
  Description of Artificial Sequence:  Enzymatic Nucleic Acid
acagacaggccgaaaggcgagugaggucugaguauac

SEQ ID NO: 2672 - RNA, 37 nt, Artificial Sequence
  Description of Artificial Sequence:  Enzymatic Nucleic Acid
uugacagagccgaaaggcgagugaggucuagcgagua

SEQ ID NO: 2673 - RNA, 37 nt, Artificial Sequence
  Description of Artificial Sequence:  Enzymatic Nucleic Acid
cugguugagccgaaaggcgagugaggucuagacagcg

SEQ ID NO: 2674 - RNA, 37 nt, Artificial Sequence
  Description of Artificial Sequence:  Enzymatic Nucleic Acid
gucaaccggccgaaaggcgagugaggucuugguugac

SEQ ID NO: 2675 - RNA, 37 nt, Artificial Sequence
  Description of Artificial Sequence:  Enzymatic Nucleic Acid
aaagucaagccgaaaggcgagugaggucucgcugguu

SEQ ID NO: 2676 - RNA, 37 nt, Artificial Sequence
  Description of Artificial Sequence:  Enzymatic Nucleic Acid
aaagaagggccgaaaggcgagugaggucuuuaaaaaa

SEQ ID NO: 2677 - RNA, 37 nt, Artificial Sequence
  Description of Artificial Sequence:  Enzymatic Nucleic Acid
uccagaaagccgaaaggcgagugaggucuugguaaaa

SEQ ID NO: 2678 - RNA, 37 nt, Artificial Sequence
  Description of Artificial Sequence:  Enzymatic Nucleic Acid
ugaauuuggccgaaaggcgagugaggucuuccagaaa

SEQ ID NO: 2679 - RNA, 37 nt, Artificial Sequence
  Description of Artificial Sequence:  Enzymatic Nucleic Acid
aaggcaaagccgaaaggcgagugaggucuugaauuug

SEQ ID NO: 2680 - RNA, 37 nt, Artificial Sequence
  Description of Artificial Sequence:  Enzymatic Nucleic Acid
caggaagggccgaaaggcgagugaggucuaaacugaa

SEQ ID NO: 2681 - RNA, 37 nt, Artificial Sequence
  Description of Artificial Sequence:  Enzymatic Nucleic Acid
acaauuuagccgaaaggcgagugaggucuaaauccag

SEQ ID NO: 2682 - RNA, 37 nt, Artificial Sequence
  Description of Artificial Sequence:  Enzymatic Nucleic Acid
ggucauuagccgaaaggcgagugaggucuaauuuaca

SEQ ID NO: 2683 - RNA, 37 nt, Artificial Sequence
  Description of Artificial Sequence:  Enzymatic Nucleic Acid
aagaacuggccgaaaggcgagugaggucuuaaaguuu

SEQ ID NO: 2684 - RNA, 37 nt, Artificial Sequence
  Description of Artificial Sequence:  Enzymatic Nucleic Acid
uggaagaagccgaaaggcgagugaggucuugcuaaag

SEQ ID NO: 2685 - RNA, 37 nt, Artificial Sequence
  Description of Artificial Sequence:  Enzymatic Nucleic Acid
gaagcaaagccgaaaggcgagugaggucucugaguca

SEQ ID NO: 2686 - RNA, 37 nt, Artificial Sequence
  Description of Artificial Sequence:  Enzymatic Nucleic Acid
cagagaaggccgaaaggcgagugaggucuaaaccuga

SEQ ID NO: 2687 - RNA, 37 nt, Artificial Sequence
  Description of Artificial Sequence:  Enzymatic Nucleic Acid
gaagaccggccgaaaggcgagugaggucucagagaag

SEQ ID NO: 2688 - RNA, 37 nt, Artificial Sequence
  Description of Artificial Sequence:  Enzymatic Nucleic Acid
ucugaagagccgaaaggcgagugaggucucgccagag

SEQ ID NO: 2689 - RNA, 37 nt, Artificial Sequence
  Description of Artificial Sequence:  Enzymatic Nucleic Acid
gauaaucagccgaaaggcgagugaggucuggaagugu

SEQ ID NO: 2690 - RNA, 37 nt, Artificial Sequence
  Description of Artificial Sequence:  Enzymatic Nucleic Acid
aaugcacggccgaaaggcgagugaggucuagauaauc

SEQ ID NO: 2691 - RNA, 37 nt, Artificial Sequence
  Description of Artificial Sequence:  Enzymatic Nucleic Acid
aaaaugcagccgaaaggcgagugaggucugcagauaa

SEQ ID NO: 2692 - RNA, 37 nt, Artificial Sequence
  Description of Artificial Sequence:  Enzymatic Nucleic Acid
ccaaaauggccgaaaggcgagugaggucuacgcagau

SEQ ID NO: 2693 - RNA, 37 nt, Artificial Sequence
  Description of Artificial Sequence:  Enzymatic Nucleic Acid
guuggaaggccgaaaggcgagugaggucuuuugucca

SEQ ID NO: 2694 - RNA, 37 nt, Artificial Sequence
  Description of Artificial Sequence:  Enzymatic Nucleic Acid
aucaccaggccgaaaggcgagugaggucucauuucuu

SEQ ID NO: 2695 - RNA, 37 nt, Artificial Sequence
  Description of Artificial Sequence:  Enzymatic Nucleic Acid
aaagaucagccgaaaggcgagugaggucucagccauu

SEQ ID NO: 2696 - RNA, 37 nt, Artificial Sequence
  Description of Artificial Sequence:  Enzymatic Nucleic Acid
gaaaccuggccgaaaggcgagugaggucuugaaagau

SEQ ID NO: 2697 - RNA, 37 nt, Artificial Sequence
  Description of Artificial Sequence:  Enzymatic Nucleic Acid
ugaagaaagccgaaaggcgagugaggucucugcugaa

SEQ ID NO: 2698 - RNA, 37 nt, Artificial Sequence
  Description of Artificial Sequence:  Enzymatic Nucleic Acid
gcuucugagccgaaaggcgagugaggucugguaugua

SEQ ID NO: 2699 - RNA, 17 nt, Homo sapiens
acuuugugacuugcggu

SEQ ID NO: 2700 - RNA, 17 nt, Homo sapiens
uugguagaaccacaggc

SEQ ID NO: 2701 - RNA, 17 nt, Homo sapiens
caggcacgacaagcaua

SEQ ID NO: 2702 - RNA, 17 nt, Homo sapiens
gcauagaaacauccuaa

SEQ ID NO: 2703 - RNA, 17 nt, Homo sapiens
cauccuaaacaaucuuc

SEQ ID NO: 2704 - RNA, 17 nt, Homo sapiens
ccuaaacaaucuucauc

SEQ ID NO: 2705 - RNA, 17 nt, Homo sapiens
ccaucccaauaaaaauc

SEQ ID NO: 2706 - RNA, 17 nt, Homo sapiens
caauaaaaaucaggaga

SEQ ID NO: 2707 - RNA, 17 nt, Homo sapiens
aucaggagacccuggcu

SEQ ID NO: 2708 - RNA, 17 nt, Homo sapiens
uaucauagaccuuaguc

SEQ ID NO: 2709 - RNA, 17 nt, Homo sapiens
gucugucaaccagcggu

SEQ ID NO: 2710 - RNA, 17 nt, Homo sapiens
agcgguugacuuuuuuu

SEQ ID NO: 2711 - RNA, 17 nt, Homo sapiens
uggagcaaauucaguuu

SEQ ID NO: 2712 - RNA, 17 nt, Homo sapiens
cuuccuggauuuguaaa

SEQ ID NO: 2713 - RNA, 17 nt, Homo sapiens
auuuguaaauuguaaug

SEQ ID NO: 2714 - RNA, 17 nt, Homo sapiens
aaauuguaaugaccuca

SEQ ID NO: 2715 - RNA, 17 nt, Homo sapiens
uuguaaugaccucaaaa

SEQ ID NO: 2716 - RNA, 17 nt, Homo sapiens
accucaaaacuuuagca

SEQ ID NO: 2717 - RNA, 17 nt, Homo sapiens
uccaucugacucagguu

SEQ ID NO: 2718 - RNA, 17 nt, Homo sapiens
ucuucagaaucaacauc

SEQ ID NO: 2719 - RNA, 17 nt, Homo sapiens
cagaaucaacauccaca

SEQ ID NO: 2720 - RNA, 17 nt, Homo sapiens
cuuccgugauuaucugc

SEQ ID NO: 2721 - RNA, 17 nt, Homo sapiens
cauuuuggacaaagcuu

SEQ ID NO: 2722 - RNA, 17 nt, Homo sapiens
agcuuccaaccaggaua

SEQ ID NO: 2723 - RNA, 17 nt, Homo sapiens
caaccaggauacgggaa

SEQ ID NO: 2724 - RNA, 17 nt, Homo sapiens
aagaagaaauggcuggu

SEQ ID NO: 2725 - RNA, 17 nt, Homo sapiens
ggcuggugaucuuucag

SEQ ID NO: 2726 - RNA, 17 nt, Homo sapiens
auggaggaacuuaauac

SEQ ID NO: 2727 - RNA, 17 nt, Homo sapiens
ggaacuuaauacauacc

SEQ ID NO: 2728 - RNA, 17 nt, Homo sapiens
guacuuaaauaucaaga

SEQ ID NO: 2729 - RNA, 17 nt, Homo sapiens
uaucaagaacugccuaa

SEQ ID NO: 2730 - RNA, 17 nt, Homo sapiens
acugccuaauucaggac

SEQ ID NO: 2731 - RNA, 17 nt, Homo sapiens
aauucaggaccuccaca

SEQ ID NO: 2732 - RNA, 17 nt, Homo sapiens
uccacaugauaggaggu

SEQ ID NO: 2733 - RNA, 17 nt, Homo sapiens
aaguuauaauagaugga

SEQ ID NO: 2734 - RNA, 17 nt, Homo sapiens
uauaauagauggaagag

SEQ ID NO: 2735 - RNA, 17 nt, Homo sapiens
ggaagagaauuuccaga

SEQ ID NO: 2736 - RNA, 17 nt, Homo sapiens
gaagguagaucaaagaa

SEQ ID NO: 2737 - RNA, 17 nt, Homo sapiens
agcaaaaaaugccgcag

SEQ ID NO: 2738 - RNA, 17 nt, Homo sapiens
gcagccaaauuagcugu

SEQ ID NO: 2739 - RNA, 17 nt, Homo sapiens
cuguugagauacuuaau

SEQ ID NO: 2740 - RNA, 17 nt, Homo sapiens
gauacuuaauaaggaaa

SEQ ID NO: 2741 - RNA, 17 nt, Homo sapiens
uauuauugacaacaacg

SEQ ID NO: 2742 - RNA, 17 nt, Homo sapiens
uauugacaacaacgaau

SEQ ID NO: 2743 - RNA, 17 nt, Homo sapiens
ugacaacaacgaauucu

SEQ ID NO: 2744 - RNA, 17 nt, Homo sapiens
aacaacgaauucuucag

SEQ ID NO: 2745 - RNA, 17 nt, Homo sapiens
ucagaaggauuauccau

SEQ ID NO: 2746 - RNA, 17 nt, Homo sapiens
cauggggaauuacauag

SEQ ID NO: 2747 - RNA, 17 nt, Homo sapiens
ccuuaucaauagaauug

SEQ ID NO: 2748 - RNA, 17 nt, Homo sapiens
ucaauagaauugcccag

SEQ ID NO: 2749 - RNA, 17 nt, Homo sapiens
aagaaaagacuaacugu

SEQ ID NO: 2750 - RNA, 17 nt, Homo sapiens
aaagacuaacuguaaau

SEQ ID NO: 2751 - RNA, 17 nt, Homo sapiens
aacuguaaauuaugaac

SEQ ID NO: 2752 - RNA, 17 nt, Homo sapiens
aauuaugaacagugugc

SEQ ID NO: 2753 - RNA, 17 nt, Homo sapiens
ccagaaggauuucauua

SEQ ID NO: 2754 - RNA, 17 nt, Homo sapiens
cauuauaaaugcaaaau

SEQ ID NO: 2755 - RNA, 17 nt, Homo sapiens
aaugcaaaaugggacag

SEQ ID NO: 2756 - RNA, 17 nt, Homo sapiens
aaaaugggacagaaaga

SEQ ID NO: 2757 - RNA, 17 nt, Homo sapiens
cagaaagaauauaguau

SEQ ID NO: 2758 - RNA, 17 nt, Homo sapiens
ucuacuaaacaggaagc

SEQ ID NO: 2759 - RNA, 17 nt, Homo sapiens
gaagcaaaacaauuggc

SEQ ID NO: 2760 - RNA, 17 nt, Homo sapiens
gcaaaacaauuggccgc

SEQ ID NO: 2761 - RNA, 17 nt, Homo sapiens
gccgcuaaacuugcaua

SEQ ID NO: 2762 - RNA, 17 nt, Homo sapiens
aucuucagauauuauca

SEQ ID NO: 2763 - RNA, 17 nt, Homo sapiens
cagaagaaaccucagug

SEQ ID NO: 2764 - RNA, 17 nt, Homo sapiens
ucagugaaaucugacua

SEQ ID NO: 2765 - RNA, 17 nt, Homo sapiens
gaaaucugacuaccugu

SEQ ID NO: 2766 - RNA, 17 nt, Homo sapiens
ccaaagcaacucuuuag

SEQ ID NO: 2767 - RNA, 17 nt, Homo sapiens
cuuuagugaccagcaca

SEQ ID NO: 2768 - RNA, 17 nt, Homo sapiens
gcuucugaaucaucauc

SEQ ID NO: 2769 - RNA, 17 nt, Homo sapiens
ugaaggugacuucucag

SEQ ID NO: 2770 - RNA, 17 nt, Homo sapiens
cucagcagauacaucag

SEQ ID NO: 2771 - RNA, 17 nt, Homo sapiens
caucagagauaaauucu

SEQ ID NO: 2772 - RNA, 17 nt, Homo sapiens
agagauaaauucuaaca

SEQ ID NO: 2773 - RNA, 17 nt, Homo sapiens
aaauucuaacagugaca

SEQ ID NO: 2774 - RNA, 17 nt, Homo sapiens
uaacagugacaguuuaa

SEQ ID NO: 2775 - RNA, 17 nt, Homo sapiens
caguuuaaacaguucuu

SEQ ID NO: 2776 - RNA, 17 nt, Homo sapiens
gcuuaugaauggucuca

SEQ ID NO: 2777 - RNA, 17 nt, Homo sapiens
ucucagaaauaaucaaa

SEQ ID NO: 2778 - RNA, 17 nt, Homo sapiens
cagaaauaaucaaagga

SEQ ID NO: 2779 - RNA, 17 nt, Homo sapiens
gcaaaaagaucuuuggc

SEQ ID NO: 2780 - RNA, 17 nt, Homo sapiens
gcacccagauuugaccu

SEQ ID NO: 2781 - RNA, 17 nt, Homo sapiens
cagauuugaccuuccug

SEQ ID NO: 2782 - RNA, 17 nt, Homo sapiens
ccuuccugacaugaaag

SEQ ID NO: 2783 - RNA, 17 nt, Homo sapiens
ugaaagaaacaaaguau

SEQ ID NO: 2784 - RNA, 17 nt, Homo sapiens
uacuguggacaagaggu

SEQ ID NO: 2785 - RNA, 17 nt, Homo sapiens
uggcauggauuuuaaag

SEQ ID NO: 2786 - RNA, 17 nt, Homo sapiens
uuaaagaaauagaauua

SEQ ID NO: 2787 - RNA, 17 nt, Homo sapiens
gaaauagaauuaauugg

SEQ ID NO: 2788 - RNA, 17 nt, Homo sapiens
uagaauuaauuggcuca

SEQ ID NO: 2789 - RNA, 17 nt, Homo sapiens
ucagguggauuuggcca

SEQ ID NO: 2790 - RNA, 17 nt, Homo sapiens
aaagcaaaacacagaau

SEQ ID NO: 2791 - RNA, 17 nt, Homo sapiens
aacacagaauugacgga

SEQ ID NO: 2792 - RNA, 17 nt, Homo sapiens
cagaauugacggaaaga

SEQ ID NO: 2793 - RNA, 17 nt, Homo sapiens
acggaaagacuuacguu

SEQ ID NO: 2794 - RNA, 17 nt, Homo sapiens
guuauuaaacguguuaa

SEQ ID NO: 2795 - RNA, 17 nt, Homo sapiens
cguguuaaauauaauaa

SEQ ID NO: 2796 - RNA, 17 nt, Homo sapiens
uaaauauaauaacgaga

SEQ ID NO: 2797 - RNA, 17 nt, Homo sapiens
auauaauaacgagaagg

SEQ ID NO: 2798 - RNA, 17 nt, Homo sapiens
uuggcaaaacuugauca

SEQ ID NO: 2799 - RNA, 17 nt, Homo sapiens
aaaacuugaucauguaa

SEQ ID NO: 2800 - RNA, 17 nt, Homo sapiens
ucauguaaauauuguuc

SEQ ID NO: 2801 - RNA, 17 nt, Homo sapiens
ucacuacaauggcuguu

SEQ ID NO: 2802 - RNA, 17 nt, Homo sapiens
cuguugggauggauuug

SEQ ID NO: 2803 - RNA, 17 nt, Homo sapiens
ugggauggauuugauua

SEQ ID NO: 2804 - RNA, 17 nt, Homo sapiens
uggauuugauuaugauc

SEQ ID NO: 2805 - RNA, 17 nt, Homo sapiens
ugauuaugauccugaga

SEQ ID NO: 2806 - RNA, 17 nt, Homo sapiens
auccugagaccagugau

SEQ ID NO: 2807 - RNA, 17 nt, Homo sapiens
gaccagugaugauucuc

SEQ ID NO: 2808 - RNA, 17 nt, Homo sapiens
cagugaugauucucuug

SEQ ID NO: 2809 - RNA, 17 nt, Homo sapiens
gagcagugauuaugauc

SEQ ID NO: 2810 - RNA, 17 nt, Homo sapiens
uccugagaacagcaaaa

SEQ ID NO: 2811 - RNA, 17 nt, Homo sapiens
cagcaaaaauaguucaa

SEQ ID NO: 2812 - RNA, 17 nt, Homo sapiens
ggucaaagacuaagugc

SEQ ID NO: 2813 - RNA, 17 nt, Homo sapiens
ucauccaaauggaauuc

SEQ ID NO: 2814 - RNA, 17 nt, Homo sapiens
caaauggaauucuguga

SEQ ID NO: 2815 - RNA, 17 nt, Homo sapiens
auucugugauaaaggga

SEQ ID NO: 2816 - RNA, 17 nt, Homo sapiens
auaaagggaccuuggaa

SEQ ID NO: 2817 - RNA, 17 nt, Homo sapiens
accuuggaacaauggau

SEQ ID NO: 2818 - RNA, 17 nt, Homo sapiens
uuggaacaauggauuga

SEQ ID NO: 2819 - RNA, 17 nt, Homo sapiens
aacaauggauugaaaaa

SEQ ID NO: 2820 - RNA, 17 nt, Homo sapiens
ggcgagaaacuagacaa

SEQ ID NO: 2821 - RNA, 17 nt, Homo sapiens
gaaacuagacaaaguuu

SEQ ID NO: 2822 - RNA, 17 nt, Homo sapiens
gcuuuggaacucuuuga

SEQ ID NO: 2823 - RNA, 17 nt, Homo sapiens
cucuuugaacaaauaac

SEQ ID NO: 2824 - RNA, 17 nt, Homo sapiens
uugaacaaauaacaaaa

SEQ ID NO: 2825 - RNA, 17 nt, Homo sapiens
aacaaauaacaaaaggg

SEQ ID NO: 2826 - RNA, 17 nt, Homo sapiens
agggguggauuauauac

SEQ ID NO: 2827 - RNA, 17 nt, Homo sapiens
ucaaaaaaauuaauuca

SEQ ID NO: 2828 - RNA, 17 nt, Homo sapiens
aaaaauuaauucauaga

SEQ ID NO: 2829 - RNA, 17 nt, Homo sapiens
ucauagagaucuuaagc

SEQ ID NO: 2830 - RNA, 17 nt, Homo sapiens
gccaaguaauauauucu

SEQ ID NO: 2831 - RNA, 17 nt, Homo sapiens
cuuaguagauacaaaac

SEQ ID NO: 2832 - RNA, 17 nt, Homo sapiens
gauacaaaacaaguaaa

SEQ ID NO: 2833 - RNA, 17 nt, Homo sapiens
aaguaaagauuggagac

SEQ ID NO: 2834 - RNA, 17 nt, Homo sapiens
gauuggagacuuuggac

SEQ ID NO: 2835 - RNA, 17 nt, Homo sapiens
gacuuuggacuuguaac

SEQ ID NO: 2836 - RNA, 17 nt, Homo sapiens
gacuuguaacaucucug

SEQ ID NO: 2837 - RNA, 17 nt, Homo sapiens
ucugaaaaaugauggaa

SEQ ID NO: 2838 - RNA, 17 nt, Homo sapiens
gaaaaaugauggaaagc

SEQ ID NO: 2839 - RNA, 17 nt, Homo sapiens
gaaagcgaacaaggagu

SEQ ID NO: 2840 - RNA, 17 nt, Homo sapiens
guaagggaacuuugcga

SEQ ID NO: 2841 - RNA, 17 nt, Homo sapiens
acuuugcgauacaugag

SEQ ID NO: 2842 - RNA, 17 nt, Homo sapiens
agcccagaacagauuuc

SEQ ID NO: 2843 - RNA, 17 nt, Homo sapiens
cagaacagauuucuucg

SEQ ID NO: 2844 - RNA, 17 nt, Homo sapiens
uucgcaagacuauggaa

SEQ ID NO: 2845 - RNA, 17 nt, Homo sapiens
ggaaguggaccucuacg

SEQ ID NO: 2846 - RNA, 17 nt, Homo sapiens
uggggcuaauucuugcu

SEQ ID NO: 2847 - RNA, 17 nt, Homo sapiens
cuugcugaacuucuuca

SEQ ID NO: 2848 - RNA, 17 nt, Homo sapiens
uguaugugacacugcuu

SEQ ID NO: 2849 - RNA, 17 nt, Homo sapiens
cuuuugaaacaucaaag

SEQ ID NO: 2850 - RNA, 17 nt, Homo sapiens
uuucacagaccuacggg

SEQ ID NO: 2851 - RNA, 17 nt, Homo sapiens
ccuacgggauggcauca

SEQ ID NO: 2852 - RNA, 17 nt, Homo sapiens
caucucagauauauuug

SEQ ID NO: 2853 - RNA, 17 nt, Homo sapiens
uauauuugauaaaaaag

SEQ ID NO: 2854 - RNA, 17 nt, Homo sapiens
aagaaaaaacucuucua

SEQ ID NO: 2855 - RNA, 17 nt, Homo sapiens
cuacagaaauuacucuc

SEQ ID NO: 2856 - RNA, 17 nt, Homo sapiens
ucaaagaaaccugagga

SEQ ID NO: 2857 - RNA, 17 nt, Homo sapiens
accugaggaucgaccua

SEQ ID NO: 2858 - RNA, 17 nt, Homo sapiens
gaggaucgaccuaacac

SEQ ID NO: 2859 - RNA, 17 nt, Homo sapiens
ucgaccuaacacaucug

SEQ ID NO: 2860 - RNA, 17 nt, Homo sapiens
caucugaaauacuaagg

SEQ ID NO: 2861 - RNA, 17 nt, Homo sapiens
uacuaaggaccuugacu

SEQ ID NO: 2862 - RNA, 17 nt, Homo sapiens
ggaccuugacugugugg

SEQ ID NO: 2863 - RNA, 17 nt, Homo sapiens
agagaaaaaugaacgac

SEQ ID NO: 2864 - RNA, 17 nt, Homo sapiens
aaaaaugaacgacacac

SEQ ID NO: 2865 - RNA, 17 nt, Homo sapiens
aaugaacgacacacaug

SEQ ID NO: 2866 - RNA, 17 nt, Homo sapiens
ugcuucugauaugcagu

SEQ ID NO: 2867 - RNA, 17 nt, Homo sapiens
uuccuuaaauuaucuaa

SEQ ID NO: 2868 - RNA, 17 nt, Homo sapiens
uaucuaaaaucugcuag

SEQ ID NO: 2869 - RNA, 17 nt, Homo sapiens
gcuagggaauaucaaua

SEQ ID NO: 2870 - RNA, 17 nt, Homo sapiens
gaauaucaauagauauu

SEQ ID NO: 2871 - RNA, 17 nt, Homo sapiens
aucaauagauauuuacc

SEQ ID NO: 2872 - RNA, 17 nt, Homo sapiens
uuauuuuaauguuuccu

SEQ ID NO: 2873 - RNA, 17 nt, Homo sapiens
uuccuuuaauuuuuuac

SEQ ID NO: 2874 - RNA, 17 nt, Homo sapiens
uuuuacuaaucuuucug

SEQ ID NO: 2875 - RNA, 17 nt, Homo sapiens
cugcagaaacagaaagg

SEQ ID NO: 2876 - RNA, 17 nt, Homo sapiens
cuucaaaaacauucuua

SEQ ID NO: 2877 - RNA, 17 nt, Homo sapiens
uuuuaaagacagagucu

SEQ ID NO: 2878 - RNA, 17 nt, Homo sapiens
ggagugcaaugacacag

SEQ ID NO: 2879 - RNA, 17 nt, Homo sapiens
gugcaaugacacagucu

SEQ ID NO: 2880 - RNA, 17 nt, Homo sapiens
ucacugcaacuucugcc

SEQ ID NO: 2881 - RNA, 17 nt, Homo sapiens
uucaagugauucuccug

SEQ ID NO: 2882 - RNA, 17 nt, Homo sapiens
guagcuggauuacaggc

SEQ ID NO: 2883 - RNA, 17 nt, Homo sapiens
cccacccaacuaauuuu

SEQ ID NO: 2884 - RNA, 17 nt, Homo sapiens
cccaacuaauuuuugug

SEQ ID NO: 2885 - RNA, 17 nt, Homo sapiens
uguuuuuaauaaagaca

SEQ ID NO: 2886 - RNA, 17 nt, Homo sapiens
uaauaaagacaggguuu

SEQ ID NO: 2887 - RNA, 17 nt, Homo sapiens
ggucucaaacuccugac

SEQ ID NO: 2888 - RNA, 17 nt, Homo sapiens
aacuccugaccucaagu

SEQ ID NO: 2889 - RNA, 17 nt, Homo sapiens
cucaaguaauccaccug

SEQ ID NO: 2890 - RNA, 17 nt, Homo sapiens
gugcugggauuacaggg

SEQ ID NO: 2891 - RNA, 17 nt, Homo sapiens
uuacagggaugagccac

SEQ ID NO: 2892 - RNA, 17 nt, Homo sapiens
uucuaaagauggaaaaa

SEQ ID NO: 2893 - RNA, 17 nt, Homo sapiens
auggaaaaaccaccccc

SEQ ID NO: 2894 - RNA, 17 nt, Homo sapiens
acccccaaauuuucuuu

SEQ ID NO: 2895 - RNA, 17 nt, Homo sapiens
uacuauuaaugaaucaa

SEQ ID NO: 2896 - RNA, 17 nt, Homo sapiens
auuaaugaaucaaucaa

SEQ ID NO: 2897 - RNA, 17 nt, Homo sapiens
augaaucaaucaauuca

SEQ ID NO: 2898 - RNA, 17 nt, Homo sapiens
aucaaucaauucauauc

SEQ ID NO: 2899 - RNA, 17 nt, Homo sapiens
uuuauuaaauuucuacc

SEQ ID NO: 2900 - RNA, 17 nt, Homo sapiens
ccaaaaaaauguaagau

SEQ ID NO: 2901 - RNA, 17 nt, Homo sapiens
aauguaagaucguucuc

SEQ ID NO: 2902 - RNA, 17 nt, Homo sapiens
cuggagaaauaugguac

SEQ ID NO: 2903 - RNA, 17 nt, Homo sapiens
aaaaagugauguacaac

SEQ ID NO: 2904 - DNA, 31 bp, Artificial Sequence
  Description of Artificial Sequence:  Enzymatic Nucleic Acid
ctgcgccgggctagctacaacgacgccgccg

SEQ ID NO: 2905 - DNA, 31 bp, Artificial Sequence
  Description of Artificial Sequence:  Enzymatic Nucleic Acid
aaactgcgggctagctacaacgacgccgccg

SEQ ID NO: 2906 - DNA, 31 bp, Artificial Sequence
  Description of Artificial Sequence:  Enzymatic Nucleic Acid
gcaaactgggctagctacaacgagccgccgc

SEQ ID NO: 2907 - DNA, 31 bp, Artificial Sequence
  Description of Artificial Sequence:  Enzymatic Nucleic Acid
tgagcaaaggctagctacaacgatgcgccgc

SEQ ID NO: 2908 - DNA, 31 bp, Artificial Sequence
  Description of Artificial Sequence:  Enzymatic Nucleic Acid
agtatgagggctagctacaacgaaaactgcg

SEQ ID NO: 2909 - DNA, 31 bp, Artificial Sequence
  Description of Artificial Sequence:  Enzymatic Nucleic Acid
acaaagtaggctagctacaacgagagcaaac

SEQ ID NO: 2910 - DNA, 31 bp, Artificial Sequence
  Description of Artificial Sequence:  Enzymatic Nucleic Acid
tcacaaagggctagctacaacgaatgagcaa

SEQ ID NO: 2911 - DNA, 31 bp, Artificial Sequence
  Description of Artificial Sequence:  Enzymatic Nucleic Acid
gcaagtcaggctagctacaacgaaaagtatg

SEQ ID NO: 2912 - DNA, 31 bp, Artificial Sequence
  Description of Artificial Sequence:  Enzymatic Nucleic Acid
accgcaagggctagctacaacgacacaaagt

SEQ ID NO: 2913 - DNA, 31 bp, Artificial Sequence
  Description of Artificial Sequence:  Enzymatic Nucleic Acid
tgtgaccgggctagctacaacgaaagtcaca

SEQ ID NO: 2914 - DNA, 31 bp, Artificial Sequence
  Description of Artificial Sequence:  Enzymatic Nucleic Acid
cactgtgaggctagctacaacgacgcaagtc

SEQ ID NO: 2915 - DNA, 31 bp, Artificial Sequence
  Description of Artificial Sequence:  Enzymatic Nucleic Acid
tgccactgggctagctacaacgagaccgcaa

SEQ ID NO: 2916 - DNA, 31 bp, Artificial Sequence
  Description of Artificial Sequence:  Enzymatic Nucleic Acid
gaatgccaggctagctacaacgatgtgaccg

SEQ ID NO: 2917 - DNA, 31 bp, Artificial Sequence
  Description of Artificial Sequence:  Enzymatic Nucleic Acid
gctgaatgggctagctacaacgacactgtga

SEQ ID NO: 2918 - DNA, 31 bp, Artificial Sequence
  Description of Artificial Sequence:  Enzymatic Nucleic Acid
gagctgaaggctagctacaacgagccactgt

SEQ ID NO: 2919 - DNA, 31 bp, Artificial Sequence
  Description of Artificial Sequence:  Enzymatic Nucleic Acid
gtgtggagggctagctacaacgatgaatgcc

SEQ ID NO: 2920 - DNA, 31 bp, Artificial Sequence
  Description of Artificial Sequence:  Enzymatic Nucleic Acid
accaagtgggctagctacaacgaggagctga

SEQ ID NO: 2921 - DNA, 31 bp, Artificial Sequence
  Description of Artificial Sequence:  Enzymatic Nucleic Acid
ctaccaagggctagctacaacgagtggagct

SEQ ID NO: 2922 - DNA, 31 bp, Artificial Sequence
  Description of Artificial Sequence:  Enzymatic Nucleic Acid
tggttctaggctagctacaacgacaagtgtg

SEQ ID NO: 2923 - DNA, 31 bp, Artificial Sequence
  Description of Artificial Sequence:  Enzymatic Nucleic Acid
gcctgtggggctagctacaacgatctaccaa

SEQ ID NO: 2924 - DNA, 31 bp, Artificial Sequence
  Description of Artificial Sequence:  Enzymatic Nucleic Acid
cgtgcctgggctagctacaacgaggttctac

SEQ ID NO: 2925 - DNA, 31 bp, Artificial Sequence
  Description of Artificial Sequence:  Enzymatic Nucleic Acid
ttgtcgtgggctagctacaacgactgtggtt

SEQ ID NO: 2926 - DNA, 31 bp, Artificial Sequence
  Description of Artificial Sequence:  Enzymatic Nucleic Acid
gcttgtcgggctagctacaacgagcctgtgg

SEQ ID NO: 2927 - DNA, 31 bp, Artificial Sequence
  Description of Artificial Sequence:  Enzymatic Nucleic Acid
tatgcttgggctagctacaacgacgtgcctg

SEQ ID NO: 2928 - DNA, 31 bp, Artificial Sequence
  Description of Artificial Sequence:  Enzymatic Nucleic Acid
tttctatgggctagctacaacgattgtcgtg

SEQ ID NO: 2929 - DNA, 31 bp, Artificial Sequence
  Description of Artificial Sequence:  Enzymatic Nucleic Acid
tgtttctaggctagctacaacgagcttgtcg

SEQ ID NO: 2930 - DNA, 31 bp, Artificial Sequence
  Description of Artificial Sequence:  Enzymatic Nucleic Acid
ttaggatgggctagctacaacgattctatgc

SEQ ID NO: 2931 - DNA, 31 bp, Artificial Sequence
  Description of Artificial Sequence:  Enzymatic Nucleic Acid
gtttaggaggctagctacaacgagtttctat

SEQ ID NO: 2932 - DNA, 31 bp, Artificial Sequence
  Description of Artificial Sequence:  Enzymatic Nucleic Acid
gaagattgggctagctacaacgattaggatg

SEQ ID NO: 2933 - DNA, 31 bp, Artificial Sequence
  Description of Artificial Sequence:  Enzymatic Nucleic Acid
gatgaagaggctagctacaacgatgtttagg

SEQ ID NO: 2934 - DNA, 31 bp, Artificial Sequence
  Description of Artificial Sequence:  Enzymatic Nucleic Acid
tgcctcgaggctagctacaacgagaagattg

SEQ ID NO: 2935 - DNA, 31 bp, Artificial Sequence
  Description of Artificial Sequence:  Enzymatic Nucleic Acid
cctcgatgggctagctacaacgactcgatga

SEQ ID NO: 2936 - DNA, 31 bp, Artificial Sequence
  Description of Artificial Sequence:  Enzymatic Nucleic Acid
gacctcgaggctagctacaacgagcctcgat

SEQ ID NO: 2937 - DNA, 31 bp, Artificial Sequence
  Description of Artificial Sequence:  Enzymatic Nucleic Acid
gggatggaggctagctacaacgactcgatgc

SEQ ID NO: 2938 - DNA, 31 bp, Artificial Sequence
  Description of Artificial Sequence:  Enzymatic Nucleic Acid
tattgggaggctagctacaacgaggacctcg

SEQ ID NO: 2939 - DNA, 31 bp, Artificial Sequence
  Description of Artificial Sequence:  Enzymatic Nucleic Acid
gatttttaggctagctacaacgatgggatgg

SEQ ID NO: 2940 - DNA, 31 bp, Artificial Sequence
  Description of Artificial Sequence:  Enzymatic Nucleic Acid
tctcctgaggctagctacaacgattttattg

SEQ ID NO: 2941 - DNA, 31 bp, Artificial Sequence
  Description of Artificial Sequence:  Enzymatic Nucleic Acid
agccagggggctagctacaacgactcctgat

SEQ ID NO: 2942 - DNA, 31 bp, Artificial Sequence
  Description of Artificial Sequence:  Enzymatic Nucleic Acid
tatgatagggctagctacaacgacagggtct

SEQ ID NO: 2943 - DNA, 31 bp, Artificial Sequence
  Description of Artificial Sequence:  Enzymatic Nucleic Acid
gtctatgaggctagctacaacgaagccaggg

SEQ ID NO: 2944 - DNA, 31 bp, Artificial Sequence
  Description of Artificial Sequence:  Enzymatic Nucleic Acid
aaggtctaggctagctacaacgagatagcca

SEQ ID NO: 2945 - DNA, 31 bp, Artificial Sequence
  Description of Artificial Sequence:  Enzymatic Nucleic Acid
gactaaggggctagctacaacgactatgata

SEQ ID NO: 2946 - DNA, 31 bp, Artificial Sequence
  Description of Artificial Sequence:  Enzymatic Nucleic Acid
agcgaagaggctagctacaacgataaggtct

SEQ ID NO: 2947 - DNA, 31 bp, Artificial Sequence
  Description of Artificial Sequence:  Enzymatic Nucleic Acid
tataccagggctagctacaacgagaagacta

SEQ ID NO: 2948 - DNA, 31 bp, Artificial Sequence
  Description of Artificial Sequence:  Enzymatic Nucleic Acid
cgagtataggctagctacaacgacagcgaag

SEQ ID NO: 2949 - DNA, 31 bp, Artificial Sequence
  Description of Artificial Sequence:  Enzymatic Nucleic Acid
agcgagtaggctagctacaacgaaccagcga

SEQ ID NO: 2950 - DNA, 31 bp, Artificial Sequence
  Description of Artificial Sequence:  Enzymatic Nucleic Acid
acagcgagggctagctacaacgaataccagc

SEQ ID NO: 2951 - DNA, 31 bp, Artificial Sequence
  Description of Artificial Sequence:  Enzymatic Nucleic Acid
acagacagggctagctacaacgagagtatac

SEQ ID NO: 2952 - DNA, 31 bp, Artificial Sequence
  Description of Artificial Sequence:  Enzymatic Nucleic Acid
ttgacagaggctagctacaacgaagcgagta

SEQ ID NO: 2953 - DNA, 31 bp, Artificial Sequence
  Description of Artificial Sequence:  Enzymatic Nucleic Acid
ctggttgaggctagctacaacgaagacagcg

SEQ ID NO: 2954 - DNA, 31 bp, Artificial Sequence
  Description of Artificial Sequence:  Enzymatic Nucleic Acid
accgctggggctagctacaacgatgacagac

SEQ ID NO: 2955 - DNA, 31 bp, Artificial Sequence
  Description of Artificial Sequence:  Enzymatic Nucleic Acid
gtcaaccgggctagctacaacgatggttgac

SEQ ID NO: 2956 - DNA, 31 bp, Artificial Sequence
  Description of Artificial Sequence:  Enzymatic Nucleic Acid
aaagtcaaggctagctacaacgacgctggtt

SEQ ID NO: 2957 - DNA, 31 bp, Artificial Sequence
  Description of Artificial Sequence:  Enzymatic Nucleic Acid
aaaaaaagggctagctacaacgacaaccgct

SEQ ID NO: 2958 - DNA, 31 bp, Artificial Sequence
  Description of Artificial Sequence:  Enzymatic Nucleic Acid
aaagaaggggctagctacaacgattaaaaaa

SEQ ID NO: 2959 - DNA, 31 bp, Artificial Sequence
  Description of Artificial Sequence:  Enzymatic Nucleic Acid
gaaactggggctagctacaacgaaaaagaga

SEQ ID NO: 2960 - DNA, 31 bp, Artificial Sequence
  Description of Artificial Sequence:  Enzymatic Nucleic Acid
tccagaaaggctagctacaacgatggtaaaa

SEQ ID NO: 2961 - DNA, 31 bp, Artificial Sequence
  Description of Artificial Sequence:  Enzymatic Nucleic Acid
tgaatttgggctagctacaacgatccagaaa

SEQ ID NO: 2962 - DNA, 31 bp, Artificial Sequence
  Description of Artificial Sequence:  Enzymatic Nucleic Acid
aaactgaaggctagctacaacgattgctcca

SEQ ID NO: 2963 - DNA, 31 bp, Artificial Sequence
  Description of Artificial Sequence:  Enzymatic Nucleic Acid
aaggcaaaggctagctacaacgatgaatttg

SEQ ID NO: 2964 - DNA, 31 bp, Artificial Sequence
  Description of Artificial Sequence:  Enzymatic Nucleic Acid
caggaaggggctagctacaacgaaaactgaa

SEQ ID NO: 2965 - DNA, 31 bp, Artificial Sequence
  Description of Artificial Sequence:  Enzymatic Nucleic Acid
tttacaaaggctagctacaacgaccaggaag

SEQ ID NO: 2966 - DNA, 31 bp, Artificial Sequence
  Description of Artificial Sequence:  Enzymatic Nucleic Acid
acaatttaggctagctacaacgaaaatccag

SEQ ID NO: 2967 - DNA, 31 bp, Artificial Sequence
  Description of Artificial Sequence:  Enzymatic Nucleic Acid
cattacaaggctagctacaacgattacaaat

SEQ ID NO: 2968 - DNA, 31 bp, Artificial Sequence
  Description of Artificial Sequence:  Enzymatic Nucleic Acid
ggtcattaggctagctacaacgaaatttaca

SEQ ID NO: 2969 - DNA, 31 bp, Artificial Sequence
  Description of Artificial Sequence:  Enzymatic Nucleic Acid
tgaggtcaggctagctacaacgatacaattt

SEQ ID NO: 2970 - DNA, 31 bp, Artificial Sequence
  Description of Artificial Sequence:  Enzymatic Nucleic Acid
ttttgaggggctagctacaacgacattacaa

SEQ ID NO: 2971 - DNA, 31 bp, Artificial Sequence
  Description of Artificial Sequence:  Enzymatic Nucleic Acid
tgctaaagggctagctacaacgatttgaggt

SEQ ID NO: 2972 - DNA, 31 bp, Artificial Sequence
  Description of Artificial Sequence:  Enzymatic Nucleic Acid
aagaactgggctagctacaacgataaagttt

SEQ ID NO: 2973 - DNA, 31 bp, Artificial Sequence
  Description of Artificial Sequence:  Enzymatic Nucleic Acid
tggaagaaggctagctacaacgatgctaaag

SEQ ID NO: 2974 - DNA, 31 bp, Artificial Sequence
  Description of Artificial Sequence:  Enzymatic Nucleic Acid
gagtcagaggctagctacaacgaggaagaac

SEQ ID NO: 2975 - DNA, 31 bp, Artificial Sequence
  Description of Artificial Sequence:  Enzymatic Nucleic Acid
aacctgagggctagctacaacgacagatgga

SEQ ID NO: 2976 - DNA, 31 bp, Artificial Sequence
  Description of Artificial Sequence:  Enzymatic Nucleic Acid
gaagcaaaggctagctacaacgactgagtca

SEQ ID NO: 2977 - DNA, 31 bp, Artificial Sequence
  Description of Artificial Sequence:  Enzymatic Nucleic Acid
cagagaagggctagctacaacgaaaacctga

SEQ ID NO: 2978 - DNA, 31 bp, Artificial Sequence
  Description of Artificial Sequence:  Enzymatic Nucleic Acid
gaagaccgggctagctacaacgacagagaag

SEQ ID NO: 2979 - DNA, 31 bp, Artificial Sequence
  Description of Artificial Sequence:  Enzymatic Nucleic Acid
tctgaagaggctagctacaacgacgccagag

SEQ ID NO: 2980 - DNA, 31 bp, Artificial Sequence
  Description of Artificial Sequence:  Enzymatic Nucleic Acid
gatgttgaggctagctacaacgatctgaaga

SEQ ID NO: 2981 - DNA, 31 bp, Artificial Sequence
  Description of Artificial Sequence:  Enzymatic Nucleic Acid
tgtggatgggctagctacaacgatgattctg

SEQ ID NO: 2982 - DNA, 31 bp, Artificial Sequence
  Description of Artificial Sequence:  Enzymatic Nucleic Acid
agtgtggaggctagctacaacgagttgattc

SEQ ID NO: 2983 - DNA, 31 bp, Artificial Sequence
  Description of Artificial Sequence:  Enzymatic Nucleic Acid
cggaagtgggctagctacaacgaggatgttg

SEQ ID NO: 2984 - DNA, 31 bp, Artificial Sequence
  Description of Artificial Sequence:  Enzymatic Nucleic Acid
cacggaagggctagctacaacgagtggatgt

SEQ ID NO: 2985 - DNA, 31 bp, Artificial Sequence
  Description of Artificial Sequence:  Enzymatic Nucleic Acid
gataatcaggctagctacaacgaggaagtgt

SEQ ID NO: 2986 - DNA, 31 bp, Artificial Sequence
  Description of Artificial Sequence:  Enzymatic Nucleic Acid
gcagataaggctagctacaacgacacggaag

SEQ ID NO: 2987 - DNA, 31 bp, Artificial Sequence
  Description of Artificial Sequence:  Enzymatic Nucleic Acid
cacgcagaggctagctacaacgaaatcacgg

SEQ ID NO: 2988 - DNA, 31 bp, Artificial Sequence
  Description of Artificial Sequence:  Enzymatic Nucleic Acid
aatgcacgggctagctacaacgaagataatc

SEQ ID NO: 2989 - DNA, 31 bp, Artificial Sequence
  Description of Artificial Sequence:  Enzymatic Nucleic Acid
aaaatgcaggctagctacaacgagcagataa

SEQ ID NO: 2990 - DNA, 31 bp, Artificial Sequence
  Description of Artificial Sequence:  Enzymatic Nucleic Acid
ccaaaatgggctagctacaacgaacgcagat

SEQ ID NO: 2991 - DNA, 31 bp, Artificial Sequence
  Description of Artificial Sequence:  Enzymatic Nucleic Acid
gtccaaaaggctagctacaacgagcacgcag

SEQ ID NO: 2992 - DNA, 31 bp, Artificial Sequence
  Description of Artificial Sequence:  Enzymatic Nucleic Acid
aagctttgggctagctacaacgaccaaaatg

SEQ ID NO: 2993 - DNA, 31 bp, Artificial Sequence
  Description of Artificial Sequence:  Enzymatic Nucleic Acid
gttggaagggctagctacaacgatttgtcca

SEQ ID NO: 2994 - DNA, 31 bp, Artificial Sequence
  Description of Artificial Sequence:  Enzymatic Nucleic Acid
tatcctggggctagctacaacgatggaagct

SEQ ID NO: 2995 - DNA, 31 bp, Artificial Sequence
  Description of Artificial Sequence:  Enzymatic Nucleic Acid
ttcccgtaggctagctacaacgacctggttg

SEQ ID NO: 2996 - DNA, 31 bp, Artificial Sequence
  Description of Artificial Sequence:  Enzymatic Nucleic Acid
tcttcccgggctagctacaacgaatcctggt

SEQ ID NO: 2997 - DNA, 31 bp, Artificial Sequence
  Description of Artificial Sequence:  Enzymatic Nucleic Acid
accagccaggctagctacaacgattcttctt

SEQ ID NO: 2998 - DNA, 31 bp, Artificial Sequence
  Description of Artificial Sequence:  Enzymatic Nucleic Acid
atcaccagggctagctacaacgacatttctt

SEQ ID NO: 2999 - DNA, 31 bp, Artificial Sequence
  Description of Artificial Sequence:  Enzymatic Nucleic Acid
aaagatcaggctagctacaacgacagccatt

SEQ ID NO: 3000 - DNA, 31 bp, Artificial Sequence
  Description of Artificial Sequence:  Enzymatic Nucleic Acid
ctgaaagaggctagctacaacgacaccagcc

SEQ ID NO: 3001 - DNA, 31 bp, Artificial Sequence
  Description of Artificial Sequence:  Enzymatic Nucleic Acid
gaaacctgggctagctacaacgatgaaagat

SEQ ID NO: 3002 - DNA, 31 bp, Artificial Sequence
  Description of Artificial Sequence:  Enzymatic Nucleic Acid
tgaagaaaggctagctacaacgactgctgaa

SEQ ID NO: 3003 - DNA, 31 bp, Artificial Sequence
  Description of Artificial Sequence:  Enzymatic Nucleic Acid
ttcctccaggctagctacaacgagaagaaac

SEQ ID NO: 3004 - DNA, 31 bp, Artificial Sequence
  Description of Artificial Sequence:  Enzymatic Nucleic Acid
gtattaagggctagctacaacgatcctccat

SEQ ID NO: 3005 - DNA, 31 bp, Artificial Sequence
  Description of Artificial Sequence:  Enzymatic Nucleic Acid
ggtatgtaggctagctacaacgataagttcc

SEQ ID NO: 3006 - DNA, 31 bp, Artificial Sequence
  Description of Artificial Sequence:  Enzymatic Nucleic Acid
acggtatgggctagctacaacgaattaagtt

SEQ ID NO: 3007 - DNA, 31 bp, Artificial Sequence
  Description of Artificial Sequence:  Enzymatic Nucleic Acid
tgacggtaggctagctacaacgagtattaag

SEQ ID NO: 3008 - DNA, 31 bp, Artificial Sequence
  Description of Artificial Sequence:  Enzymatic Nucleic Acid
tctgacggggctagctacaacgaatgtatta

SEQ ID NO: 3009 - DNA, 31 bp, Artificial Sequence
  Description of Artificial Sequence:  Enzymatic Nucleic Acid
gcttctgaggctagctacaacgaggtatgta

SEQ ID NO: 3010 - DNA, 31 bp, Artificial Sequence
  Description of Artificial Sequence:  Enzymatic Nucleic Acid
actccctgggctagctacaacgattctgacg

SEQ ID NO: 3011 - DNA, 31 bp, Artificial Sequence
  Description of Artificial Sequence:  Enzymatic Nucleic Acid
aagtactaggctagctacaacgatccctgct

SEQ ID NO: 3012 - DNA, 31 bp, Artificial Sequence
  Description of Artificial Sequence:  Enzymatic Nucleic Acid
tttaagtaggctagctacaacgatactccct

SEQ ID NO: 3013 - DNA, 31 bp, Artificial Sequence
  Description of Artificial Sequence:  Enzymatic Nucleic Acid
tatttaagggctagctacaacgaactactcc

SEQ ID NO: 3014 - DNA, 31 bp, Artificial Sequence
  Description of Artificial Sequence:  Enzymatic Nucleic Acid
tcttgataggctagctacaacgattaagtac

SEQ ID NO: 3015 - DNA, 31 bp, Artificial Sequence
  Description of Artificial Sequence:  Enzymatic Nucleic Acid
gttcttgaggctagctacaacgaatttaagt

SEQ ID NO: 3016 - DNA, 31 bp, Artificial Sequence
  Description of Artificial Sequence:  Enzymatic Nucleic Acid
ttaggcagggctagctacaacgatcttgata

SEQ ID NO: 3017 - DNA, 31 bp, Artificial Sequence
  Description of Artificial Sequence:  Enzymatic Nucleic Acid
gaattaggggctagctacaacgaagttcttg

SEQ ID NO: 3018 - DNA, 31 bp, Artificial Sequence
  Description of Artificial Sequence:  Enzymatic Nucleic Acid
gtcctgaaggctagctacaacgataggcagt

SEQ ID NO: 3019 - DNA, 31 bp, Artificial Sequence
  Description of Artificial Sequence:  Enzymatic Nucleic Acid
tgtggaggggctagctacaacgacctgaatt

SEQ ID NO: 3020 - DNA, 31 bp, Artificial Sequence
  Description of Artificial Sequence:  Enzymatic Nucleic Acid
ctatcatgggctagctacaacgaggaggtcc

SEQ ID NO: 3021 - DNA, 31 bp, Artificial Sequence
  Description of Artificial Sequence:  Enzymatic Nucleic Acid
tcctatcaggctagctacaacgagtggaggt

SEQ ID NO: 3022 - DNA, 31 bp, Artificial Sequence
  Description of Artificial Sequence:  Enzymatic Nucleic Acid
acctcctaggctagctacaacgacatgtgga

SEQ ID NO: 3023 - DNA, 31 bp, Artificial Sequence
  Description of Artificial Sequence:  Enzymatic Nucleic Acid
aatgtaaaggctagctacaacgactcctatc

SEQ ID NO: 3024 - DNA, 31 bp, Artificial Sequence
  Description of Artificial Sequence:  Enzymatic Nucleic Acid
ttgaaatgggctagctacaacgaaaacctcc

SEQ ID NO: 3025 - DNA, 31 bp, Artificial Sequence
  Description of Artificial Sequence:  Enzymatic Nucleic Acid
acttgaaaggctagctacaacgagtaaacct

SEQ ID NO: 3026 - DNA, 31 bp, Artificial Sequence
  Description of Artificial Sequence:  Enzymatic Nucleic Acid
tattataaggctagctacaacgattgaaatg

SEQ ID NO: 3027 - DNA, 31 bp, Artificial Sequence
  Description of Artificial Sequence:  Enzymatic Nucleic Acid
atctattaggctagctacaacgaaacttgaa

SEQ ID NO: 3028 - DNA, 31 bp, Artificial Sequence
  Description of Artificial Sequence:  Enzymatic Nucleic Acid
tccatctaggctagctacaacgatataactt

SEQ ID NO: 3029 - DNA, 31 bp, Artificial Sequence
  Description of Artificial Sequence:  Enzymatic Nucleic Acid
ctcttccaggctagctacaacgactattata

SEQ ID NO: 3030 - DNA, 31 bp, Artificial Sequence
  Description of Artificial Sequence:  Enzymatic Nucleic Acid
tctggaaaggctagctacaacgatctcttcc

SEQ ID NO: 3031 - DNA, 31 bp, Artificial Sequence
  Description of Artificial Sequence:  Enzymatic Nucleic Acid
taccttcaggctagctacaacgacttctgga

SEQ ID NO: 3032 - DNA, 31 bp, Artificial Sequence
  Description of Artificial Sequence:  Enzymatic Nucleic Acid
ttgatctaggctagctacaacgacttcacct

SEQ ID NO: 3033 - DNA, 31 bp, Artificial Sequence
  Description of Artificial Sequence:  Enzymatic Nucleic Acid
ttctttgaggctagctacaacgactaccttc

SEQ ID NO: 3034 - DNA, 31 bp, Artificial Sequence
  Description of Artificial Sequence:  Enzymatic Nucleic Acid
attttttgggctagctacaacgattccttct

SEQ ID NO: 3035 - DNA, 31 bp, Artificial Sequence
  Description of Artificial Sequence:  Enzymatic Nucleic Acid
ctgcggcaggctagctacaacgatttttgct

SEQ ID NO: 3036 - DNA, 31 bp, Artificial Sequence
  Description of Artificial Sequence:  Enzymatic Nucleic Acid
ggctgcggggctagctacaacgaattttttg

SEQ ID NO: 3037 - DNA, 31 bp, Artificial Sequence
  Description of Artificial Sequence:  Enzymatic Nucleic Acid
tttggctgggctagctacaacgaggcatttt

SEQ ID NO: 3038 - DNA, 31 bp, Artificial Sequence
  Description of Artificial Sequence:  Enzymatic Nucleic Acid
taatttggggctagctacaacgatgcggcat

SEQ ID NO: 3039 - DNA, 31 bp, Artificial Sequence
  Description of Artificial Sequence:  Enzymatic Nucleic Acid
acagctaaggctagctacaacgattggctgc

SEQ ID NO: 3040 - DNA, 31 bp, Artificial Sequence
  Description of Artificial Sequence:  Enzymatic Nucleic Acid
ctcaacagggctagctacaacgataatttgg

SEQ ID NO: 3041 - DNA, 31 bp, Artificial Sequence
  Description of Artificial Sequence:  Enzymatic Nucleic Acid
tatctcaaggctagctacaacgaagctaatt

SEQ ID NO: 3042 - DNA, 31 bp, Artificial Sequence
  Description of Artificial Sequence:  Enzymatic Nucleic Acid
attaagtaggctagctacaacgactcaacag

SEQ ID NO: 3043 - DNA, 31 bp, Artificial Sequence
  Description of Artificial Sequence:  Enzymatic Nucleic Acid
ttattaagggctagctacaacgaatctcaac

SEQ ID NO: 3044 - DNA, 31 bp, Artificial Sequence
  Description of Artificial Sequence:  Enzymatic Nucleic Acid
tttccttaggctagctacaacgataagtatc

SEQ ID NO: 3045 - DNA, 31 bp, Artificial Sequence
  Description of Artificial Sequence:  Enzymatic Nucleic Acid
actaactgggctagctacaacgacttctttt

SEQ ID NO: 3046 - DNA, 31 bp, Artificial Sequence
  Description of Artificial Sequence:  Enzymatic Nucleic Acid
aggactaaggctagctacaacgatgccttct

SEQ ID NO: 3047 - DNA, 31 bp, Artificial Sequence
  Description of Artificial Sequence:  Enzymatic Nucleic Acid
ataaaggaggctagctacaacgataactgcc

SEQ ID NO: 3048 - DNA, 31 bp, Artificial Sequence
  Description of Artificial Sequence:  Enzymatic Nucleic Acid
gtcaataaggctagctacaacgaaaaggact

SEQ ID NO: 3049 - DNA, 31 bp, Artificial Sequence
  Description of Artificial Sequence:  Enzymatic Nucleic Acid
gttgtcaaggctagctacaacgaaataaagg

SEQ ID NO: 3050 - DNA, 31 bp, Artificial Sequence
  Description of Artificial Sequence:  Enzymatic Nucleic Acid
cgttgttgggctagctacaacgacaataata

SEQ ID NO: 3051 - DNA, 31 bp, Artificial Sequence
  Description of Artificial Sequence:  Enzymatic Nucleic Acid
attcgttgggctagctacaacgatgtcaata

SEQ ID NO: 3052 - DNA, 31 bp, Artificial Sequence
  Description of Artificial Sequence:  Enzymatic Nucleic Acid
agaattcgggctagctacaacgatgttgtca

SEQ ID NO: 3053 - DNA, 31 bp, Artificial Sequence
  Description of Artificial Sequence:  Enzymatic Nucleic Acid
ctgaagaaggctagctacaacgatcgttgtt

SEQ ID NO: 3054 - DNA, 31 bp, Artificial Sequence
  Description of Artificial Sequence:  Enzymatic Nucleic Acid
atggataaggctagctacaacgaccttctga

SEQ ID NO: 3055 - DNA, 31 bp, Artificial Sequence
  Description of Artificial Sequence:  Enzymatic Nucleic Acid
cccatggaggctagctacaacgaaatccttc

SEQ ID NO: 3056 - DNA, 31 bp, Artificial Sequence
  Description of Artificial Sequence:  Enzymatic Nucleic Acid
attccccaggctagctacaacgaggataatc

SEQ ID NO: 3057 - DNA, 31 bp, Artificial Sequence
  Description of Artificial Sequence:  Enzymatic Nucleic Acid
ctatgtaaggctagctacaacgatccccatg

SEQ ID NO: 3058 - DNA, 31 bp, Artificial Sequence
  Description of Artificial Sequence:  Enzymatic Nucleic Acid
ggcctatgggctagctacaacgaaattcccc

SEQ ID NO: 3059 - DNA, 31 bp, Artificial Sequence
  Description of Artificial Sequence:  Enzymatic Nucleic Acid
aaggcctaggctagctacaacgagtaattcc

SEQ ID NO: 3060 - DNA, 31 bp, Artificial Sequence
  Description of Artificial Sequence:  Enzymatic Nucleic Acid
tgataaggggctagctacaacgactatgtaa

SEQ ID NO: 3061 - DNA, 31 bp, Artificial Sequence
  Description of Artificial Sequence:  Enzymatic Nucleic Acid
tctattgaggctagctacaacgaaaggccta

SEQ ID NO: 3062 - DNA, 31 bp, Artificial Sequence
  Description of Artificial Sequence:  Enzymatic Nucleic Acid
caattctaggctagctacaacgatgataagg

SEQ ID NO: 3063 - DNA, 31 bp, Artificial Sequence
  Description of Artificial Sequence:  Enzymatic Nucleic Acid
ctgggcaaggctagctacaacgatctattga

SEQ ID NO: 3064 - DNA, 31 bp, Artificial Sequence
  Description of Artificial Sequence:  Enzymatic Nucleic Acid
cttctgggggctagctacaacgaaattctat

SEQ ID NO: 3065 - DNA, 31 bp, Artificial Sequence
  Description of Artificial Sequence:  Enzymatic Nucleic Acid
acagttagggctagctacaacgacttttctt

SEQ ID NO: 3066 - DNA, 31 bp, Artificial Sequence
  Description of Artificial Sequence:  Enzymatic Nucleic Acid
atttacagggctagctacaacgatagtcttt

SEQ ID NO: 3067 - DNA, 31 bp, Artificial Sequence
  Description of Artificial Sequence:  Enzymatic Nucleic Acid
ataatttaggctagctacaacgaagttagtc

SEQ ID NO: 3068 - DNA, 31 bp, Artificial Sequence
  Description of Artificial Sequence:  Enzymatic Nucleic Acid
gttcataaggctagctacaacgattacagtt

SEQ ID NO: 3069 - DNA, 31 bp, Artificial Sequence
  Description of Artificial Sequence:  Enzymatic Nucleic Acid
actgttcaggctagctacaacgaaatttaca

SEQ ID NO: 3070 - DNA, 31 bp, Artificial Sequence
  Description of Artificial Sequence:  Enzymatic Nucleic Acid
gcacactgggctagctacaacgatcataatt

SEQ ID NO: 3071 - DNA, 31 bp, Artificial Sequence
  Description of Artificial Sequence:  Enzymatic Nucleic Acid
gatgcacaggctagctacaacgatgttcata

SEQ ID NO: 3072 - DNA, 31 bp, Artificial Sequence
  Description of Artificial Sequence:  Enzymatic Nucleic Acid
ccgatgcaggctagctacaacgaactgttca

SEQ ID NO: 3073 - DNA, 31 bp, Artificial Sequence
  Description of Artificial Sequence:  Enzymatic Nucleic Acid
ccccgatgggctagctacaacgaacactgtt

SEQ ID NO: 3074 - DNA, 31 bp, Artificial Sequence
  Description of Artificial Sequence:  Enzymatic Nucleic Acid
acccccgaggctagctacaacgagcacactg

SEQ ID NO: 3075 - DNA, 31 bp, Artificial Sequence
  Description of Artificial Sequence:  Enzymatic Nucleic Acid
cccatgcaggctagctacaacgaccccgatg

SEQ ID NO: 3076 - DNA, 31 bp, Artificial Sequence
  Description of Artificial Sequence:  Enzymatic Nucleic Acid
ggcccatgggctagctacaacgaacccccga

SEQ ID NO: 3077 - DNA, 31 bp, Artificial Sequence
  Description of Artificial Sequence:  Enzymatic Nucleic Acid
ctggcccaggctagctacaacgagcaccccc

SEQ ID NO: 3078 - DNA, 31 bp, Artificial Sequence
  Description of Artificial Sequence:  Enzymatic Nucleic Acid
ccttctggggctagctacaacgaccatgcac

SEQ ID NO: 3079 - DNA, 31 bp, Artificial Sequence
  Description of Artificial Sequence:  Enzymatic Nucleic Acid
taatgaaaggctagctacaacgaccttctgg

SEQ ID NO: 3080 - DNA, 31 bp, Artificial Sequence
  Description of Artificial Sequence:  Enzymatic Nucleic Acid
atttataaggctagctacaacgagaaatcct

SEQ ID NO: 3081 - DNA, 31 bp, Artificial Sequence
  Description of Artificial Sequence:  Enzymatic Nucleic Acid
tgcatttaggctagctacaacgaaatgaaat

SEQ ID NO: 3082 - DNA, 31 bp, Artificial Sequence
  Description of Artificial Sequence:  Enzymatic Nucleic Acid
attttgcaggctagctacaacgattataatg

SEQ ID NO: 3083 - DNA, 31 bp, Artificial Sequence
  Description of Artificial Sequence:  Enzymatic Nucleic Acid
ccattttgggctagctacaacgaatttataa

SEQ ID NO: 3084 - DNA, 31 bp, Artificial Sequence
  Description of Artificial Sequence:  Enzymatic Nucleic Acid
ctgtcccaggctagctacaacgatttgcatt

SEQ ID NO: 3085 - DNA, 31 bp, Artificial Sequence
  Description of Artificial Sequence:  Enzymatic Nucleic Acid
tctttctgggctagctacaacgacccatttt

SEQ ID NO: 3086 - DNA, 31 bp, Artificial Sequence
  Description of Artificial Sequence:  Enzymatic Nucleic Acid
atactataggctagctacaacgatctttctg

SEQ ID NO: 3087 - DNA, 31 bp, Artificial Sequence
  Description of Artificial Sequence:  Enzymatic Nucleic Acid
caatactaggctagctacaacgaattctttc

SEQ ID NO: 3088 - DNA, 31 bp, Artificial Sequence
  Description of Artificial Sequence:  Enzymatic Nucleic Acid
taccaataggctagctacaacgatatattct

SEQ ID NO: 3089 - DNA, 31 bp, Artificial Sequence
  Description of Artificial Sequence:  Enzymatic Nucleic Acid
tgtaccaaggctagctacaacgaactatatt

SEQ ID NO: 3090 - DNA, 31 bp, Artificial Sequence
  Description of Artificial Sequence:  Enzymatic Nucleic Acid
aacctgtaggctagctacaacgacaatacta

SEQ ID NO: 3091 - DNA, 31 bp, Artificial Sequence
  Description of Artificial Sequence:  Enzymatic Nucleic Acid
agaacctgggctagctacaacgaaccaatac

SEQ ID NO: 3092 - DNA, 31 bp, Artificial Sequence
  Description of Artificial Sequence:  Enzymatic Nucleic Acid
tagtagaaggctagctacaacgactgtacca

SEQ ID NO: 3093 - DNA, 31 bp, Artificial Sequence
  Description of Artificial Sequence:  Enzymatic Nucleic Acid
ctgtttagggctagctacaacgaagaacctg

SEQ ID NO: 3094 - DNA, 31 bp, Artificial Sequence
  Description of Artificial Sequence:  Enzymatic Nucleic Acid
gcttcctgggctagctacaacgattagtaga

SEQ ID NO: 3095 - DNA, 31 bp, Artificial Sequence
  Description of Artificial Sequence:  Enzymatic Nucleic Acid
ttgttttgggctagctacaacgattcctgtt

SEQ ID NO: 3096 - DNA, 31 bp, Artificial Sequence
  Description of Artificial Sequence:  Enzymatic Nucleic Acid
gccaattgggctagctacaacgatttgcttc

SEQ ID NO: 3097 - DNA, 31 bp, Artificial Sequence
  Description of Artificial Sequence:  Enzymatic Nucleic Acid
gcggccaaggctagctacaacgatgttttgc

SEQ ID NO: 3098 - DNA, 31 bp, Artificial Sequence
  Description of Artificial Sequence:  Enzymatic Nucleic Acid
tttagcggggctagctacaacgacaattgtt

SEQ ID NO: 3099 - DNA, 31 bp, Artificial Sequence
  Description of Artificial Sequence:  Enzymatic Nucleic Acid
aagtttagggctagctacaacgaggccaatt

SEQ ID NO: 3100 - DNA, 31 bp, Artificial Sequence
  Description of Artificial Sequence:  Enzymatic Nucleic Acid
tatgcaagggctagctacaacgattagcggc

SEQ ID NO: 3101 - DNA, 31 bp, Artificial Sequence
  Description of Artificial Sequence:  Enzymatic Nucleic Acid
aagatatgggctagctacaacgaaagtttag

SEQ ID NO: 3102 - DNA, 31 bp, Artificial Sequence
  Description of Artificial Sequence:  Enzymatic Nucleic Acid
tgaagataggctagctacaacgagcaagttt

SEQ ID NO: 3103 - DNA, 31 bp, Artificial Sequence
  Description of Artificial Sequence:  Enzymatic Nucleic Acid
tctgaagaggctagctacaacgaatgcaagt

SEQ ID NO: 3104 - DNA, 31 bp, Artificial Sequence
  Description of Artificial Sequence:  Enzymatic Nucleic Acid
tgataataggctagctacaacgactgaagat

SEQ ID NO: 3105 - DNA, 31 bp, Artificial Sequence
  Description of Artificial Sequence:  Enzymatic Nucleic Acid
tctgataaggctagctacaacgaatctgaag

SEQ ID NO: 3106 - DNA, 31 bp, Artificial Sequence
  Description of Artificial Sequence:  Enzymatic Nucleic Acid
tcttctgaggctagctacaacgaaatatctg

SEQ ID NO: 3107 - DNA, 31 bp, Artificial Sequence
  Description of Artificial Sequence:  Enzymatic Nucleic Acid
cactgaggggctagctacaacgattcttctg

SEQ ID NO: 3108 - DNA, 31 bp, Artificial Sequence
  Description of Artificial Sequence:  Enzymatic Nucleic Acid
agatttcaggctagctacaacgatgaggttt

SEQ ID NO: 3109 - DNA, 31 bp, Artificial Sequence
  Description of Artificial Sequence:  Enzymatic Nucleic Acid
tagtcagaggctagctacaacgattcactga

SEQ ID NO: 3110 - DNA, 31 bp, Artificial Sequence
  Description of Artificial Sequence:  Enzymatic Nucleic Acid
acaggtagggctagctacaacgacagatttc

SEQ ID NO: 3111 - DNA, 31 bp, Artificial Sequence
  Description of Artificial Sequence:  Enzymatic Nucleic Acid
aggacaggggctagctacaacgaagtcagat

SEQ ID NO: 3112 - DNA, 31 bp, Artificial Sequence
  Description of Artificial Sequence:  Enzymatic Nucleic Acid
ccagaggaggctagctacaacgaaggtagtc

SEQ ID NO: 3113 - DNA, 31 bp, Artificial Sequence
  Description of Artificial Sequence:  Enzymatic Nucleic Acid
caaaagaaggctagctacaacgacagaggac

SEQ ID NO: 3114 - DNA, 31 bp, Artificial Sequence
  Description of Artificial Sequence:  Enzymatic Nucleic Acid
cgtagtagggctagctacaacgaaaaagaac

SEQ ID NO: 3115 - DNA, 31 bp, Artificial Sequence
  Description of Artificial Sequence:  Enzymatic Nucleic Acid
acacgtagggctagctacaacgaagcaaaag

SEQ ID NO: 3116 - DNA, 31 bp, Artificial Sequence
  Description of Artificial Sequence:  Enzymatic Nucleic Acid
ctcacacgggctagctacaacgaagtagcaa

SEQ ID NO: 3117 - DNA, 31 bp, Artificial Sequence
  Description of Artificial Sequence:  Enzymatic Nucleic Acid
gactcacaggctagctacaacgagtagtagc

SEQ ID NO: 3118 - DNA, 31 bp, Artificial Sequence
  Description of Artificial Sequence:  Enzymatic Nucleic Acid
gggactcaggctagctacaacgaacgtagta

SEQ ID NO: 3119 - DNA, 31 bp, Artificial Sequence
  Description of Artificial Sequence:  Enzymatic Nucleic Acid
ctttgggaggctagctacaacgatcacacgt

SEQ ID NO: 3120 - DNA, 31 bp, Artificial Sequence
  Description of Artificial Sequence:  Enzymatic Nucleic Acid
aagagttgggctagctacaacgatttgggac

SEQ ID NO: 3121 - DNA, 31 bp, Artificial Sequence
  Description of Artificial Sequence:  Enzymatic Nucleic Acid
ctaaagagggctagctacaacgatgctttgg

SEQ ID NO: 3122 - DNA, 31 bp, Artificial Sequence
  Description of Artificial Sequence:  Enzymatic Nucleic Acid
gctggtcaggctagctacaacgataaagagt

SEQ ID NO: 3123 - DNA, 31 bp, Artificial Sequence
  Description of Artificial Sequence:  Enzymatic Nucleic Acid
tgtgctggggctagctacaacgacactaaag

SEQ ID NO: 3124 - DNA, 31 bp, Artificial Sequence
  Description of Artificial Sequence:  Enzymatic Nucleic Acid
cgagtgtgggctagctacaacgatggtcact

SEQ ID NO: 3125 - DNA, 31 bp, Artificial Sequence
  Description of Artificial Sequence:  Enzymatic Nucleic Acid
agcgagtgggctagctacaacgagctggtca

SEQ ID NO: 3126 - DNA, 31 bp, Artificial Sequence
  Description of Artificial Sequence:  Enzymatic Nucleic Acid
gaagcgagggctagctacaacgagtgctggt

SEQ ID NO: 3127 - DNA, 31 bp, Artificial Sequence
  Description of Artificial Sequence:  Enzymatic Nucleic Acid
ttcagaagggctagctacaacgagagtgtgc

SEQ ID NO: 3128 - DNA, 31 bp, Artificial Sequence
  Description of Artificial Sequence:  Enzymatic Nucleic Acid
gatgatgaggctagctacaacgatcagaagc

SEQ ID NO: 3129 - DNA, 31 bp, Artificial Sequence
  Description of Artificial Sequence:  Enzymatic Nucleic Acid
tcagatgaggctagctacaacgagattcaga

SEQ ID NO: 3130 - DNA, 31 bp, Artificial Sequence
  Description of Artificial Sequence:  Enzymatic Nucleic Acid
ccttcagaggctagctacaacgagatgattc

SEQ ID NO: 3131 - DNA, 31 bp, Artificial Sequence
  Description of Artificial Sequence:  Enzymatic Nucleic Acid
agaagtcaggctagctacaacgacttcagat

SEQ ID NO: 3132 - DNA, 31 bp, Artificial Sequence
  Description of Artificial Sequence:  Enzymatic Nucleic Acid
ctgagaagggctagctacaacgacaccttca

SEQ ID NO: 3133 - DNA, 31 bp, Artificial Sequence
  Description of Artificial Sequence:  Enzymatic Nucleic Acid
tgtatctgggctagctacaacgatgagaagt

SEQ ID NO: 3134 - DNA, 31 bp, Artificial Sequence
  Description of Artificial Sequence:  Enzymatic Nucleic Acid
ctgatgtaggctagctacaacgactgctgag

SEQ ID NO: 3135 - DNA, 31 bp, Artificial Sequence
  Description of Artificial Sequence:  Enzymatic Nucleic Acid
ctctgatgggctagctacaacgaatctgctg

SEQ ID NO: 3136 - DNA, 31 bp, Artificial Sequence
  Description of Artificial Sequence:  Enzymatic Nucleic Acid
atctctgaggctagctacaacgagtatctgc

SEQ ID NO: 3137 - DNA, 31 bp, Artificial Sequence
  Description of Artificial Sequence:  Enzymatic Nucleic Acid
agaatttaggctagctacaacgactctgatg

SEQ ID NO: 3138 - DNA, 31 bp, Artificial Sequence
  Description of Artificial Sequence:  Enzymatic Nucleic Acid
tgttagaaggctagctacaacgattatctct

SEQ ID NO: 3139 - DNA, 31 bp, Artificial Sequence
  Description of Artificial Sequence:  Enzymatic Nucleic Acid
tgtcactgggctagctacaacgatagaattt

SEQ ID NO: 3140 - DNA, 31 bp, Artificial Sequence
  Description of Artificial Sequence:  Enzymatic Nucleic Acid
aactgtcaggctagctacaacgatgttagaa

SEQ ID NO: 3141 - DNA, 31 bp, Artificial Sequence
  Description of Artificial Sequence:  Enzymatic Nucleic Acid
ttaaactgggctagctacaacgacactgtta

SEQ ID NO: 3142 - DNA, 31 bp, Artificial Sequence
  Description of Artificial Sequence:  Enzymatic Nucleic Acid
tgtttaaaggctagctacaacgatgtcactg

SEQ ID NO: 3143 - DNA, 31 bp, Artificial Sequence
  Description of Artificial Sequence:  Enzymatic Nucleic Acid
aagaactgggctagctacaacgattaaactg

SEQ ID NO: 3144 - DNA, 31 bp, Artificial Sequence
  Description of Artificial Sequence:  Enzymatic Nucleic Acid
acgaagaaggctagctacaacgatgtttaaa

SEQ ID NO: 3145 - DNA, 31 bp, Artificial Sequence
  Description of Artificial Sequence:  Enzymatic Nucleic Acid
ataagcaaggctagctacaacgagaagaact

SEQ ID NO: 3146 - DNA, 31 bp, Artificial Sequence
  Description of Artificial Sequence:  Enzymatic Nucleic Acid
ttcataagggctagctacaacgaaacgaaga

SEQ ID NO: 3147 - DNA, 31 bp, Artificial Sequence
  Description of Artificial Sequence:  Enzymatic Nucleic Acid
accattcaggctagctacaacgaaagcaacg

SEQ ID NO: 3148 - DNA, 31 bp, Artificial Sequence
  Description of Artificial Sequence:  Enzymatic Nucleic Acid
tgagaccaggctagctacaacgatcataagc

SEQ ID NO: 3149 - DNA, 31 bp, Artificial Sequence
  Description of Artificial Sequence:  Enzymatic Nucleic Acid
ttctgagaggctagctacaacgacattcata

SEQ ID NO: 3150 - DNA, 31 bp, Artificial Sequence
  Description of Artificial Sequence:  Enzymatic Nucleic Acid
tttgattaggctagctacaacgattctgaga

SEQ ID NO: 3151 - DNA, 31 bp, Artificial Sequence
  Description of Artificial Sequence:  Enzymatic Nucleic Acid
tcctttgaggctagctacaacgatatttctg

SEQ ID NO: 3152 - DNA, 31 bp, Artificial Sequence
  Description of Artificial Sequence:  Enzymatic Nucleic Acid
tctttttgggctagctacaacgacttccttt

SEQ ID NO: 3153 - DNA, 31 bp, Artificial Sequence
  Description of Artificial Sequence:  Enzymatic Nucleic Acid
gccaaagaggctagctacaacgactttttgc

SEQ ID NO: 3154 - DNA, 31 bp, Artificial Sequence
  Description of Artificial Sequence:  Enzymatic Nucleic Acid
tctgggtgggctagctacaacgacaaagatc

SEQ ID NO: 3155 - DNA, 31 bp, Artificial Sequence
  Description of Artificial Sequence:  Enzymatic Nucleic Acid
aatctgggggctagctacaacgagccaaaga

SEQ ID NO: 3156 - DNA, 31 bp, Artificial Sequence
  Description of Artificial Sequence:  Enzymatic Nucleic Acid
aggtcaaaggctagctacaacgactgggtgc

SEQ ID NO: 3157 - DNA, 31 bp, Artificial Sequence
  Description of Artificial Sequence:  Enzymatic Nucleic Acid
caggaaggggctagctacaacgacaaatctg

SEQ ID NO: 3158 - DNA, 31 bp, Artificial Sequence
  Description of Artificial Sequence:  Enzymatic Nucleic Acid
ctttcatgggctagctacaacgacaggaagg

SEQ ID NO: 3159 - DNA, 31 bp, Artificial Sequence
  Description of Artificial Sequence:  Enzymatic Nucleic Acid
ttctttcaggctagctacaacgagtcaggaa

SEQ ID NO: 3160 - DNA, 31 bp, Artificial Sequence
  Description of Artificial Sequence:  Enzymatic Nucleic Acid
atactttgggctagctacaacgattctttca

SEQ ID NO: 3161 - DNA, 31 bp, Artificial Sequence
  Description of Artificial Sequence:  Enzymatic Nucleic Acid
acagtataggctagctacaacgatttgtttc

SEQ ID NO: 3162 - DNA, 31 bp, Artificial Sequence
  Description of Artificial Sequence:  Enzymatic Nucleic Acid
ccacagtaggctagctacaacgaactttgtt

SEQ ID NO: 3163 - DNA, 31 bp, Artificial Sequence
  Description of Artificial Sequence:  Enzymatic Nucleic Acid
gtccacagggctagctacaacgaatactttg

SEQ ID NO: 3164 - DNA, 31 bp, Artificial Sequence
  Description of Artificial Sequence:  Enzymatic Nucleic Acid
cttgtccaggctagctacaacgaagtatact

SEQ ID NO: 3165 - DNA, 31 bp, Artificial Sequence
  Description of Artificial Sequence:  Enzymatic Nucleic Acid
acctcttgggctagctacaacgaccacagta

SEQ ID NO: 3166 - DNA, 31 bp, Artificial Sequence
  Description of Artificial Sequence:  Enzymatic Nucleic Acid
atgccaaaggctagctacaacgactcttgtc

SEQ ID NO: 3167 - DNA, 31 bp, Artificial Sequence
  Description of Artificial Sequence:  Enzymatic Nucleic Acid
aatccatgggctagctacaacgacaaacctc

SEQ ID NO: 3168 - DNA, 31 bp, Artificial Sequence
  Description of Artificial Sequence:  Enzymatic Nucleic Acid
aaaatccaggctagctacaacgagccaaacc

SEQ ID NO: 3169 - DNA, 31 bp, Artificial Sequence
  Description of Artificial Sequence:  Enzymatic Nucleic Acid
ctttaaaaggctagctacaacgaccatgcca

SEQ ID NO: 3170 - DNA, 31 bp, Artificial Sequence
  Description of Artificial Sequence:  Enzymatic Nucleic Acid
taattctaggctagctacaacgattctttaa

SEQ ID NO: 3171 - DNA, 31 bp, Artificial Sequence
  Description of Artificial Sequence:  Enzymatic Nucleic Acid
ccaattaaggctagctacaacgatctatttc

SEQ ID NO: 3172 - DNA, 31 bp, Artificial Sequence
  Description of Artificial Sequence:  Enzymatic Nucleic Acid
tgagccaaggctagctacaacgataattcta

SEQ ID NO: 3173 - DNA, 31 bp, Artificial Sequence
  Description of Artificial Sequence:  Enzymatic Nucleic Acid
cacctgagggctagctacaacgacaattaat

SEQ ID NO: 3174 - DNA, 31 bp, Artificial Sequence
  Description of Artificial Sequence:  Enzymatic Nucleic Acid
caaatccaggctagctacaacgactgagcca

SEQ ID NO: 3175 - DNA, 31 bp, Artificial Sequence
  Description of Artificial Sequence:  Enzymatic Nucleic Acid
tggccaaaggctagctacaacgaccacctga

SEQ ID NO: 3176 - DNA, 31 bp, Artificial Sequence
  Description of Artificial Sequence:  Enzymatic Nucleic Acid
aaacttggggctagctacaacgacaaatcca

SEQ ID NO: 3177 - DNA, 31 bp, Artificial Sequence
  Description of Artificial Sequence:  Enzymatic Nucleic Acid
tttgaaaaggctagctacaacgattggccaa

SEQ ID NO: 3178 - DNA, 31 bp, Artificial Sequence
  Description of Artificial Sequence:  Enzymatic Nucleic Acid
gtgttttgggctagctacaacgatttgaaaa

SEQ ID NO: 3179 - DNA, 31 bp, Artificial Sequence
  Description of Artificial Sequence:  Enzymatic Nucleic Acid
attctgtgggctagctacaacgatttgcttt

SEQ ID NO: 3180 - DNA, 31 bp, Artificial Sequence
  Description of Artificial Sequence:  Enzymatic Nucleic Acid
caattctgggctagctacaacgagttttgct

SEQ ID NO: 3181 - DNA, 31 bp, Artificial Sequence
  Description of Artificial Sequence:  Enzymatic Nucleic Acid
tccgtcaaggctagctacaacgatctgtgtt

SEQ ID NO: 3182 - DNA, 31 bp, Artificial Sequence
  Description of Artificial Sequence:  Enzymatic Nucleic Acid
tctttccgggctagctacaacgacaattctg

SEQ ID NO: 3183 - DNA, 31 bp, Artificial Sequence
  Description of Artificial Sequence:  Enzymatic Nucleic Acid
aacgtaagggctagctacaacgactttccgt

SEQ ID NO: 3184 - DNA, 31 bp, Artificial Sequence
  Description of Artificial Sequence:  Enzymatic Nucleic Acid
taataacgggctagctacaacgaaagtcttt

SEQ ID NO: 3185 - DNA, 31 bp, Artificial Sequence
  Description of Artificial Sequence:  Enzymatic Nucleic Acid
tttaataaggctagctacaacgagtaagtct

SEQ ID NO: 3186 - DNA, 31 bp, Artificial Sequence
  Description of Artificial Sequence:  Enzymatic Nucleic Acid
acgtttaaggctagctacaacgaaacgtaag

SEQ ID NO: 3187 - DNA, 31 bp, Artificial Sequence
  Description of Artificial Sequence:  Enzymatic Nucleic Acid
ttaacacgggctagctacaacgattaataac

SEQ ID NO: 3188 - DNA, 31 bp, Artificial Sequence
  Description of Artificial Sequence:  Enzymatic Nucleic Acid
atttaacaggctagctacaacgagtttaata

SEQ ID NO: 3189 - DNA, 31 bp, Artificial Sequence
  Description of Artificial Sequence:  Enzymatic Nucleic Acid
atatttaaggctagctacaacgaacgtttaa

SEQ ID NO: 3190 - DNA, 31 bp, Artificial Sequence
  Description of Artificial Sequence:  Enzymatic Nucleic Acid
ttattataggctagctacaacgattaacacg

SEQ ID NO: 3191 - DNA, 31 bp, Artificial Sequence
  Description of Artificial Sequence:  Enzymatic Nucleic Acid
cgttattaggctagctacaacgaatttaaca

SEQ ID NO: 3192 - DNA, 31 bp, Artificial Sequence
  Description of Artificial Sequence:  Enzymatic Nucleic Acid
tctcgttaggctagctacaacgatatattta

SEQ ID NO: 3193 - DNA, 31 bp, Artificial Sequence
  Description of Artificial Sequence:  Enzymatic Nucleic Acid
ccttctcgggctagctacaacgatattatat

SEQ ID NO: 3194 - DNA, 31 bp, Artificial Sequence
  Description of Artificial Sequence:  Enzymatic Nucleic Acid
acgctccgggctagctacaacgacttctcgt

SEQ ID NO: 3195 - DNA, 31 bp, Artificial Sequence
  Description of Artificial Sequence:  Enzymatic Nucleic Acid
acttcacgggctagctacaacgatccgcctt

SEQ ID NO: 3196 - DNA, 31 bp, Artificial Sequence
  Description of Artificial Sequence:  Enzymatic Nucleic Acid
ttacttcaggctagctacaacgagctccgcc

SEQ ID NO: 3197 - DNA, 31 bp, Artificial Sequence
  Description of Artificial Sequence:  Enzymatic Nucleic Acid
tgcttttaggctagctacaacgattcacgct

SEQ ID NO: 3198 - DNA, 31 bp, Artificial Sequence
  Description of Artificial Sequence:  Enzymatic Nucleic Acid
tgccaatgggctagctacaacgattttactt

SEQ ID NO: 3199 - DNA, 31 bp, Artificial Sequence
  Description of Artificial Sequence:  Enzymatic Nucleic Acid
tttgccaaggctagctacaacgagcttttac

SEQ ID NO: 3200 - DNA, 31 bp, Artificial Sequence
  Description of Artificial Sequence:  Enzymatic Nucleic Acid
aagttttgggctagctacaacgacaatgctt

SEQ ID NO: 3201 - DNA, 31 bp, Artificial Sequence
  Description of Artificial Sequence:  Enzymatic Nucleic Acid
tgatcaagggctagctacaacgatttgccaa

SEQ ID NO: 3202 - DNA, 31 bp, Artificial Sequence
  Description of Artificial Sequence:  Enzymatic Nucleic Acid
ttacatgaggctagctacaacgacaagtttt

SEQ ID NO: 3203 - DNA, 31 bp, Artificial Sequence
  Description of Artificial Sequence:  Enzymatic Nucleic Acid
tatttacaggctagctacaacgagatcaagt

SEQ ID NO: 3204 - DNA, 31 bp, Artificial Sequence
  Description of Artificial Sequence:  Enzymatic Nucleic Acid
aatatttaggctagctacaacgaatgatcaa

SEQ ID NO: 3205 - DNA, 31 bp, Artificial Sequence
  Description of Artificial Sequence:  Enzymatic Nucleic Acid
gaacaataggctagctacaacgattacatga

SEQ ID NO: 3206 - DNA, 31 bp, Artificial Sequence
  Description of Artificial Sequence:  Enzymatic Nucleic Acid
gtgaacaaggctagctacaacgaatttacat

SEQ ID NO: 3207 - DNA, 31 bp, Artificial Sequence
  Description of Artificial Sequence:  Enzymatic Nucleic Acid
gtagtgaaggctagctacaacgaaatattta

SEQ ID NO: 3208 - DNA, 31 bp, Artificial Sequence
  Description of Artificial Sequence:  Enzymatic Nucleic Acid
cattgtagggctagctacaacgagaacaata

SEQ ID NO: 3209 - DNA, 31 bp, Artificial Sequence
  Description of Artificial Sequence:  Enzymatic Nucleic Acid
agccattgggctagctacaacgaagtgaaca

SEQ ID NO: 3210 - DNA, 31 bp, Artificial Sequence
  Description of Artificial Sequence:  Enzymatic Nucleic Acid
aacagccaggctagctacaacgatgtagtga

SEQ ID NO: 3211 - DNA, 31 bp, Artificial Sequence
  Description of Artificial Sequence:  Enzymatic Nucleic Acid
cccaacagggctagctacaacgacattgtag

SEQ ID NO: 3212 - DNA, 31 bp, Artificial Sequence
  Description of Artificial Sequence:  Enzymatic Nucleic Acid
catcccaaggctagctacaacgaagccattg

SEQ ID NO: 3213 - DNA, 31 bp, Artificial Sequence
  Description of Artificial Sequence:  Enzymatic Nucleic Acid
caaatccaggctagctacaacgacccaacag

SEQ ID NO: 3214 - DNA, 31 bp, Artificial Sequence
  Description of Artificial Sequence:  Enzymatic Nucleic Acid
taatcaaaggctagctacaacgaccatccca

SEQ ID NO: 3215 - DNA, 31 bp, Artificial Sequence
  Description of Artificial Sequence:  Enzymatic Nucleic Acid
gatcataaggctagctacaacgacaaatcca

SEQ ID NO: 3216 - DNA, 31 bp, Artificial Sequence
  Description of Artificial Sequence:  Enzymatic Nucleic Acid
caggatcaggctagctacaacgaaatcaaat

SEQ ID NO: 3217 - DNA, 31 bp, Artificial Sequence
  Description of Artificial Sequence:  Enzymatic Nucleic Acid
tctcaggaggctagctacaacgacataatca

SEQ ID NO: 3218 - DNA, 31 bp, Artificial Sequence
  Description of Artificial Sequence:  Enzymatic Nucleic Acid
atcactggggctagctacaacgactcaggat

SEQ ID NO: 3219 - DNA, 31 bp, Artificial Sequence
  Description of Artificial Sequence:  Enzymatic Nucleic Acid
aatcatcaggctagctacaacgatggtctca

SEQ ID NO: 3220 - DNA, 31 bp, Artificial Sequence
  Description of Artificial Sequence:  Enzymatic Nucleic Acid
gagaatcaggctagctacaacgacactggtc

SEQ ID NO: 3221 - DNA, 31 bp, Artificial Sequence
  Description of Artificial Sequence:  Enzymatic Nucleic Acid
caagagaaggctagctacaacgacatcactg

SEQ ID NO: 3222 - DNA, 31 bp, Artificial Sequence
  Description of Artificial Sequence:  Enzymatic Nucleic Acid
aatcactgggctagctacaacgatctcaaga

SEQ ID NO: 3223 - DNA, 31 bp, Artificial Sequence
  Description of Artificial Sequence:  Enzymatic Nucleic Acid
cataatcaggctagctacaacgatgctctca

SEQ ID NO: 3224 - DNA, 31 bp, Artificial Sequence
  Description of Artificial Sequence:  Enzymatic Nucleic Acid
gatcataaggctagctacaacgacactgctc

SEQ ID NO: 3225 - DNA, 31 bp, Artificial Sequence
  Description of Artificial Sequence:  Enzymatic Nucleic Acid
caggatcaggctagctacaacgaaatcactg

SEQ ID NO: 3226 - DNA, 31 bp, Artificial Sequence
  Description of Artificial Sequence:  Enzymatic Nucleic Acid
ttttgctgggctagctacaacgatctcagga

SEQ ID NO: 3227 - DNA, 31 bp, Artificial Sequence
  Description of Artificial Sequence:  Enzymatic Nucleic Acid
tatttttgggctagctacaacgatgttctca

SEQ ID NO: 3228 - DNA, 31 bp, Artificial Sequence
  Description of Artificial Sequence:  Enzymatic Nucleic Acid
ttgaactaggctagctacaacgattttgctg

SEQ ID NO: 3229 - DNA, 31 bp, Artificial Sequence
  Description of Artificial Sequence:  Enzymatic Nucleic Acid
accttgaaggctagctacaacgatatttttg

SEQ ID NO: 3230 - DNA, 31 bp, Artificial Sequence
  Description of Artificial Sequence:  Enzymatic Nucleic Acid
gtctttgaggctagctacaacgacttgaact

SEQ ID NO: 3231 - DNA, 31 bp, Artificial Sequence
  Description of Artificial Sequence:  Enzymatic Nucleic Acid
gcacttagggctagctacaacgactttgacc

SEQ ID NO: 3232 - DNA, 31 bp, Artificial Sequence
  Description of Artificial Sequence:  Enzymatic Nucleic Acid
aaaaggcaggctagctacaacgattagtctt

SEQ ID NO: 3233 - DNA, 31 bp, Artificial Sequence
  Description of Artificial Sequence:  Enzymatic Nucleic Acid
tgaaaaggggctagctacaacgaacttagtc

SEQ ID NO: 3234 - DNA, 31 bp, Artificial Sequence
  Description of Artificial Sequence:  Enzymatic Nucleic Acid
catttggaggctagctacaacgagaaaaggc

SEQ ID NO: 3235 - DNA, 31 bp, Artificial Sequence
  Description of Artificial Sequence:  Enzymatic Nucleic Acid
gaattccaggctagctacaacgattggatga

SEQ ID NO: 3236 - DNA, 31 bp, Artificial Sequence
  Description of Artificial Sequence:  Enzymatic Nucleic Acid
tcacagaaggctagctacaacgatccatttg

SEQ ID NO: 3237 - DNA, 31 bp, Artificial Sequence
  Description of Artificial Sequence:  Enzymatic Nucleic Acid
ctttatcaggctagctacaacgaagaattcc

SEQ ID NO: 3238 - DNA, 31 bp, Artificial Sequence
  Description of Artificial Sequence:  Enzymatic Nucleic Acid
tccctttaggctagctacaacgacacagaat

SEQ ID NO: 3239 - DNA, 31 bp, Artificial Sequence
  Description of Artificial Sequence:  Enzymatic Nucleic Acid
ttccaaggggctagctacaacgaccctttat

SEQ ID NO: 3240 - DNA, 31 bp, Artificial Sequence
  Description of Artificial Sequence:  Enzymatic Nucleic Acid
atccattgggctagctacaacgatccaaggt

SEQ ID NO: 3241 - DNA, 31 bp, Artificial Sequence
  Description of Artificial Sequence:  Enzymatic Nucleic Acid
tcaatccaggctagctacaacgatgttccaa

SEQ ID NO: 3242 - DNA, 31 bp, Artificial Sequence
  Description of Artificial Sequence:  Enzymatic Nucleic Acid
tttttcaaggctagctacaacgaccattgtt

SEQ ID NO: 3243 - DNA, 31 bp, Artificial Sequence
  Description of Artificial Sequence:  Enzymatic Nucleic Acid
gtttctcgggctagctacaacgactcttctt

SEQ ID NO: 3244 - DNA, 31 bp, Artificial Sequence
  Description of Artificial Sequence:  Enzymatic Nucleic Acid
ttgtctagggctagctacaacgattctcgcc

SEQ ID NO: 3245 - DNA, 31 bp, Artificial Sequence
  Description of Artificial Sequence:  Enzymatic Nucleic Acid
aaactttgggctagctacaacgactagtttc

SEQ ID NO: 3246 - DNA, 31 bp, Artificial Sequence
  Description of Artificial Sequence:  Enzymatic Nucleic Acid
agccaaaaggctagctacaacgatttgtcta

SEQ ID NO: 3247 - DNA, 31 bp, Artificial Sequence
  Description of Artificial Sequence:  Enzymatic Nucleic Acid
ttccaaagggctagctacaacgacaaaactt

SEQ ID NO: 3248 - DNA, 31 bp, Artificial Sequence
  Description of Artificial Sequence:  Enzymatic Nucleic Acid
tcaaagagggctagctacaacgatccaaagc

SEQ ID NO: 3249 - DNA, 31 bp, Artificial Sequence
  Description of Artificial Sequence:  Enzymatic Nucleic Acid
gttatttgggctagctacaacgatcaaagag

SEQ ID NO: 3250 - DNA, 31 bp, Artificial Sequence
  Description of Artificial Sequence:  Enzymatic Nucleic Acid
ttttgttaggctagctacaacgattgttcaa

SEQ ID NO: 3251 - DNA, 31 bp, Artificial Sequence
  Description of Artificial Sequence:  Enzymatic Nucleic Acid
cccttttgggctagctacaacgatatttgtt

SEQ ID NO: 3252 - DNA, 31 bp, Artificial Sequence
  Description of Artificial Sequence:  Enzymatic Nucleic Acid
ataatccaggctagctacaacgacccttttg

SEQ ID NO: 3253 - DNA, 31 bp, Artificial Sequence
  Description of Artificial Sequence:  Enzymatic Nucleic Acid
gtatataaggctagctacaacgaccacccct

SEQ ID NO: 3254 - DNA, 31 bp, Artificial Sequence
  Description of Artificial Sequence:  Enzymatic Nucleic Acid
aatgtataggctagctacaacgaaatccacc

SEQ ID NO: 3255 - DNA, 31 bp, Artificial Sequence
  Description of Artificial Sequence:  Enzymatic Nucleic Acid
tgaatgtaggctagctacaacgaataatcca

SEQ ID NO: 3256 - DNA, 31 bp, Artificial Sequence
  Description of Artificial Sequence:  Enzymatic Nucleic Acid
tttgaatgggctagctacaacgaatataatc

SEQ ID NO: 3257 - DNA, 31 bp, Artificial Sequence
  Description of Artificial Sequence:  Enzymatic Nucleic Acid
tttttgaaggctagctacaacgagtatataa

SEQ ID NO: 3258 - DNA, 31 bp, Artificial Sequence
  Description of Artificial Sequence:  Enzymatic Nucleic Acid
tgaattaaggctagctacaacgattttttga

SEQ ID NO: 3259 - DNA, 31 bp, Artificial Sequence
  Description of Artificial Sequence:  Enzymatic Nucleic Acid
tctatgaaggctagctacaacgataattttt

SEQ ID NO: 3260 - DNA, 31 bp, Artificial Sequence
  Description of Artificial Sequence:  Enzymatic Nucleic Acid
gatctctaggctagctacaacgagaattaat

SEQ ID NO: 3261 - DNA, 31 bp, Artificial Sequence
  Description of Artificial Sequence:  Enzymatic Nucleic Acid
gcttaagaggctagctacaacgactctatga

SEQ ID NO: 3262 - DNA, 31 bp, Artificial Sequence
  Description of Artificial Sequence:  Enzymatic Nucleic Acid
ttacttggggctagctacaacgattaagatc

SEQ ID NO: 3263 - DNA, 31 bp, Artificial Sequence
  Description of Artificial Sequence:  Enzymatic Nucleic Acid
atatattaggctagctacaacgattggctta

SEQ ID NO: 3264 - DNA, 31 bp, Artificial Sequence
  Description of Artificial Sequence:  Enzymatic Nucleic Acid
agaatataggctagctacaacgatacttggc

SEQ ID NO: 3265 - DNA, 31 bp, Artificial Sequence
  Description of Artificial Sequence:  Enzymatic Nucleic Acid
taagaataggctagctacaacgaattacttg

SEQ ID NO: 3266 - DNA, 31 bp, Artificial Sequence
  Description of Artificial Sequence:  Enzymatic Nucleic Acid
actaagaaggctagctacaacgaatattact

SEQ ID NO: 3267 - DNA, 31 bp, Artificial Sequence
  Description of Artificial Sequence:  Enzymatic Nucleic Acid
tgtatctaggctagctacaacgataagaata

SEQ ID NO: 3268 - DNA, 31 bp, Artificial Sequence
  Description of Artificial Sequence:  Enzymatic Nucleic Acid
gttttgtaggctagctacaacgactactaag

SEQ ID NO: 3269 - DNA, 31 bp, Artificial Sequence
  Description of Artificial Sequence:  Enzymatic Nucleic Acid
ttgttttgggctagctacaacgaatctacta

SEQ ID NO: 3270 - DNA, 31 bp, Artificial Sequence
  Description of Artificial Sequence:  Enzymatic Nucleic Acid
tttacttgggctagctacaacgatttgtatc

SEQ ID NO: 3271 - DNA, 31 bp, Artificial Sequence
  Description of Artificial Sequence:  Enzymatic Nucleic Acid
aatctttaggctagctacaacgattgttttg

SEQ ID NO: 3272 - DNA, 31 bp, Artificial Sequence
  Description of Artificial Sequence:  Enzymatic Nucleic Acid
gtctccaaggctagctacaacgactttactt

SEQ ID NO: 3273 - DNA, 31 bp, Artificial Sequence
  Description of Artificial Sequence:  Enzymatic Nucleic Acid
gtccaaagggctagctacaacgactccaatc

SEQ ID NO: 3274 - DNA, 31 bp, Artificial Sequence
  Description of Artificial Sequence:  Enzymatic Nucleic Acid
gttacaagggctagctacaacgaccaaagtc

SEQ ID NO: 3275 - DNA, 31 bp, Artificial Sequence
  Description of Artificial Sequence:  Enzymatic Nucleic Acid
agatgttaggctagctacaacgaaagtccaa

SEQ ID NO: 3276 - DNA, 31 bp, Artificial Sequence
  Description of Artificial Sequence:  Enzymatic Nucleic Acid
cagagatgggctagctacaacgatacaagtc

SEQ ID NO: 3277 - DNA, 31 bp, Artificial Sequence
  Description of Artificial Sequence:  Enzymatic Nucleic Acid
ttcagagaggctagctacaacgagttacaag

SEQ ID NO: 3278 - DNA, 31 bp, Artificial Sequence
  Description of Artificial Sequence:  Enzymatic Nucleic Acid
ttccatcaggctagctacaacgattttcaga

SEQ ID NO: 3279 - DNA, 31 bp, Artificial Sequence
  Description of Artificial Sequence:  Enzymatic Nucleic Acid
gctttccaggctagctacaacgacatttttc

SEQ ID NO: 3280 - DNA, 31 bp, Artificial Sequence
  Description of Artificial Sequence:  Enzymatic Nucleic Acid
cttgttcgggctagctacaacgatttccatc

SEQ ID NO: 3281 - DNA, 31 bp, Artificial Sequence
  Description of Artificial Sequence:  Enzymatic Nucleic Acid
actccttgggctagctacaacgatcgctttc

SEQ ID NO: 3282 - DNA, 31 bp, Artificial Sequence
  Description of Artificial Sequence:  Enzymatic Nucleic Acid
ttcccttaggctagctacaacgatccttgtt

SEQ ID NO: 3283 - DNA, 31 bp, Artificial Sequence
  Description of Artificial Sequence:  Enzymatic Nucleic Acid
tcgcaaagggctagctacaacgatcccttac

SEQ ID NO: 3284 - DNA, 31 bp, Artificial Sequence
  Description of Artificial Sequence:  Enzymatic Nucleic Acid
atgtatcgggctagctacaacgaaaagttcc

SEQ ID NO: 3285 - DNA, 31 bp, Artificial Sequence
  Description of Artificial Sequence:  Enzymatic Nucleic Acid
ctcatgtaggctagctacaacgacgcaaagt

SEQ ID NO: 3286 - DNA, 31 bp, Artificial Sequence
  Description of Artificial Sequence:  Enzymatic Nucleic Acid
ggctcatgggctagctacaacgaatcgcaaa

SEQ ID NO: 3287 - DNA, 31 bp, Artificial Sequence
  Description of Artificial Sequence:  Enzymatic Nucleic Acid
tgggctcaggctagctacaacgagtatcgca

SEQ ID NO: 3288 - DNA, 31 bp, Artificial Sequence
  Description of Artificial Sequence:  Enzymatic Nucleic Acid
gttctgggggctagctacaacgatcatgtat

SEQ ID NO: 3289 - DNA, 31 bp, Artificial Sequence
  Description of Artificial Sequence:  Enzymatic Nucleic Acid
gaaatctgggctagctacaacgatctgggct

SEQ ID NO: 3290 - DNA, 31 bp, Artificial Sequence
  Description of Artificial Sequence:  Enzymatic Nucleic Acid
cgaagaaaggctagctacaacgactgttctg

SEQ ID NO: 3291 - DNA, 31 bp, Artificial Sequence
  Description of Artificial Sequence:  Enzymatic Nucleic Acid
tagtcttgggctagctacaacgagaagaaat

SEQ ID NO: 3292 - DNA, 31 bp, Artificial Sequence
  Description of Artificial Sequence:  Enzymatic Nucleic Acid
ttccatagggctagctacaacgacttgcgaa

SEQ ID NO: 3293 - DNA, 31 bp, Artificial Sequence
  Description of Artificial Sequence:  Enzymatic Nucleic Acid
cctttccaggctagctacaacgaagtcttgc

SEQ ID NO: 3294 - DNA, 31 bp, Artificial Sequence
  Description of Artificial Sequence:  Enzymatic Nucleic Acid
gaggtccaggctagctacaacgattcctttc

SEQ ID NO: 3295 - DNA, 31 bp, Artificial Sequence
  Description of Artificial Sequence:  Enzymatic Nucleic Acid
cgtagaggggctagctacaacgaccacttcc

SEQ ID NO: 3296 - DNA, 31 bp, Artificial Sequence
  Description of Artificial Sequence:  Enzymatic Nucleic Acid
ccaaagcgggctagctacaacgaagaggtcc

SEQ ID NO: 3297 - DNA, 31 bp, Artificial Sequence
  Description of Artificial Sequence:  Enzymatic Nucleic Acid
ccccaaagggctagctacaacgagtagaggt

SEQ ID NO: 3298 - DNA, 31 bp, Artificial Sequence
  Description of Artificial Sequence:  Enzymatic Nucleic Acid
agaattagggctagctacaacgacccaaagc

SEQ ID NO: 3299 - DNA, 31 bp, Artificial Sequence
  Description of Artificial Sequence:  Enzymatic Nucleic Acid
agcaagaaggctagctacaacgatagcccca

SEQ ID NO: 3300 - DNA, 31 bp, Artificial Sequence
  Description of Artificial Sequence:  Enzymatic Nucleic Acid
aagttcagggctagctacaacgaaagaatta

SEQ ID NO: 3301 - DNA, 31 bp, Artificial Sequence
  Description of Artificial Sequence:  Enzymatic Nucleic Acid
tgaagaagggctagctacaacgatcagcaag

SEQ ID NO: 3302 - DNA, 31 bp, Artificial Sequence
  Description of Artificial Sequence:  Enzymatic Nucleic Acid
cacatacaggctagctacaacgagaagaagt

SEQ ID NO: 3303 - DNA, 31 bp, Artificial Sequence
  Description of Artificial Sequence:  Enzymatic Nucleic Acid
gtcacataggctagctacaacgaatgaagaa

SEQ ID NO: 3304 - DNA, 31 bp, Artificial Sequence
  Description of Artificial Sequence:  Enzymatic Nucleic Acid
gtgtcacaggctagctacaacgaacatgaag

SEQ ID NO: 3305 - DNA, 31 bp, Artificial Sequence
  Description of Artificial Sequence:  Enzymatic Nucleic Acid
cagtgtcaggctagctacaacgaatacatga

SEQ ID NO: 3306 - DNA, 31 bp, Artificial Sequence
  Description of Artificial Sequence:  Enzymatic Nucleic Acid
aagcagtgggctagctacaacgacacataca

SEQ ID NO: 3307 - DNA, 31 bp, Artificial Sequence
  Description of Artificial Sequence:  Enzymatic Nucleic Acid
aaaagcagggctagctacaacgagtcacata

SEQ ID NO: 3308 - DNA, 31 bp, Artificial Sequence
  Description of Artificial Sequence:  Enzymatic Nucleic Acid
ttcaaaagggctagctacaacgaagtgtcac

SEQ ID NO: 3309 - DNA, 31 bp, Artificial Sequence
  Description of Artificial Sequence:  Enzymatic Nucleic Acid
ctttgatgggctagctacaacgattcaaaag

SEQ ID NO: 3310 - DNA, 31 bp, Artificial Sequence
  Description of Artificial Sequence:  Enzymatic Nucleic Acid
aactttgaggctagctacaacgagtttcaaa

SEQ ID NO: 3311 - DNA, 31 bp, Artificial Sequence
  Description of Artificial Sequence:  Enzymatic Nucleic Acid
gtgaaaaaggctagctacaacgatttgatgt

SEQ ID NO: 3312 - DNA, 31 bp, Artificial Sequence
  Description of Artificial Sequence:  Enzymatic Nucleic Acid
taggtctgggctagctacaacgagaaaaact

SEQ ID NO: 3313 - DNA, 31 bp, Artificial Sequence
  Description of Artificial Sequence:  Enzymatic Nucleic Acid
cccgtaggggctagctacaacgactgtgaaa

SEQ ID NO: 3314 - DNA, 31 bp, Artificial Sequence
  Description of Artificial Sequence:  Enzymatic Nucleic Acid
ccatcccgggctagctacaacgaaggtctgt

SEQ ID NO: 3315 - DNA, 31 bp, Artificial Sequence
  Description of Artificial Sequence:  Enzymatic Nucleic Acid
tgatgccaggctagctacaacgacccgtagg

SEQ ID NO: 3316 - DNA, 31 bp, Artificial Sequence
  Description of Artificial Sequence:  Enzymatic Nucleic Acid
agatgatgggctagctacaacgacatcccgt

SEQ ID NO: 3317 - DNA, 31 bp, Artificial Sequence
  Description of Artificial Sequence:  Enzymatic Nucleic Acid
tgagatgaggctagctacaacgagccatccc

SEQ ID NO: 3318 - DNA, 31 bp, Artificial Sequence
  Description of Artificial Sequence:  Enzymatic Nucleic Acid
atctgagaggctagctacaacgagatgccat

SEQ ID NO: 3319 - DNA, 31 bp, Artificial Sequence
  Description of Artificial Sequence:  Enzymatic Nucleic Acid
caaatataggctagctacaacgactgagatg

SEQ ID NO: 3320 - DNA, 31 bp, Artificial Sequence
  Description of Artificial Sequence:  Enzymatic Nucleic Acid
atcaaataggctagctacaacgaatctgaga

SEQ ID NO: 3321 - DNA, 31 bp, Artificial Sequence
  Description of Artificial Sequence:  Enzymatic Nucleic Acid
ttatcaaaggctagctacaacgaatatctga

SEQ ID NO: 3322 - DNA, 31 bp, Artificial Sequence
  Description of Artificial Sequence:  Enzymatic Nucleic Acid
cttttttaggctagctacaacgacaaatata

SEQ ID NO: 3323 - DNA, 31 bp, Artificial Sequence
  Description of Artificial Sequence:  Enzymatic Nucleic Acid
tagaagagggctagctacaacgatttttctt

SEQ ID NO: 3324 - DNA, 31 bp, Artificial Sequence
  Description of Artificial Sequence:  Enzymatic Nucleic Acid
aatttctgggctagctacaacgaagaagagt

SEQ ID NO: 3325 - DNA, 31 bp, Artificial Sequence
  Description of Artificial Sequence:  Enzymatic Nucleic Acid
gagagtaaggctagctacaacgattctgtag

SEQ ID NO: 3326 - DNA, 31 bp, Artificial Sequence
  Description of Artificial Sequence:  Enzymatic Nucleic Acid
tttgagagggctagctacaacgaaatttctg

SEQ ID NO: 3327 - DNA, 31 bp, Artificial Sequence
  Description of Artificial Sequence:  Enzymatic Nucleic Acid
tcctcaggggctagctacaacgattctttga

SEQ ID NO: 3328 - DNA, 31 bp, Artificial Sequence
  Description of Artificial Sequence:  Enzymatic Nucleic Acid
taggtcgaggctagctacaacgacctcaggt

SEQ ID NO: 3329 - DNA, 31 bp, Artificial Sequence
  Description of Artificial Sequence:  Enzymatic Nucleic Acid
gtgttaggggctagctacaacgacgatcctc

SEQ ID NO: 3330 - DNA, 31 bp, Artificial Sequence
  Description of Artificial Sequence:  Enzymatic Nucleic Acid
cagatgtgggctagctacaacgataggtcga

SEQ ID NO: 3331 - DNA, 31 bp, Artificial Sequence
  Description of Artificial Sequence:  Enzymatic Nucleic Acid
ttcagatgggctagctacaacgagttaggtc

SEQ ID NO: 3332 - DNA, 31 bp, Artificial Sequence
  Description of Artificial Sequence:  Enzymatic Nucleic Acid
atttcagaggctagctacaacgagtgttagg

SEQ ID NO: 3333 - DNA, 31 bp, Artificial Sequence
  Description of Artificial Sequence:  Enzymatic Nucleic Acid
ccttagtaggctagctacaacgattcagatg

SEQ ID NO: 3334 - DNA, 31 bp, Artificial Sequence
  Description of Artificial Sequence:  Enzymatic Nucleic Acid
gtccttagggctagctacaacgaatttcaga

SEQ ID NO: 3335 - DNA, 31 bp, Artificial Sequence
  Description of Artificial Sequence:  Enzymatic Nucleic Acid
agtcaaggggctagctacaacgaccttagta

SEQ ID NO: 3336 - DNA, 31 bp, Artificial Sequence
  Description of Artificial Sequence:  Enzymatic Nucleic Acid
ccacacagggctagctacaacgacaaggtcc

SEQ ID NO: 3337 - DNA, 31 bp, Artificial Sequence
  Description of Artificial Sequence:  Enzymatic Nucleic Acid
cttccacaggctagctacaacgaagtcaagg

SEQ ID NO: 3338 - DNA, 31 bp, Artificial Sequence
  Description of Artificial Sequence:  Enzymatic Nucleic Acid
ttcttccaggctagctacaacgaacagtcaa

SEQ ID NO: 3339 - DNA, 31 bp, Artificial Sequence
  Description of Artificial Sequence:  Enzymatic Nucleic Acid
tctctgggggctagctacaacgattttcttc

SEQ ID NO: 3340 - DNA, 31 bp, Artificial Sequence
  Description of Artificial Sequence:  Enzymatic Nucleic Acid
gtcgttcaggctagctacaacgattttctct

SEQ ID NO: 3341 - DNA, 31 bp, Artificial Sequence
  Description of Artificial Sequence:  Enzymatic Nucleic Acid
gtgtgtcgggctagctacaacgatcattttt

SEQ ID NO: 3342 - DNA, 31 bp, Artificial Sequence
  Description of Artificial Sequence:  Enzymatic Nucleic Acid
catgtgtgggctagctacaacgacgttcatt

SEQ ID NO: 3343 - DNA, 31 bp, Artificial Sequence
  Description of Artificial Sequence:  Enzymatic Nucleic Acid
aacatgtgggctagctacaacgagtcgttca

SEQ ID NO: 3344 - DNA, 31 bp, Artificial Sequence
  Description of Artificial Sequence:  Enzymatic Nucleic Acid
ctaacatgggctagctacaacgagtgtcgtt

SEQ ID NO: 3345 - DNA, 31 bp, Artificial Sequence
  Description of Artificial Sequence:  Enzymatic Nucleic Acid
ctctaacaggctagctacaacgagtgtgtcg

SEQ ID NO: 3346 - DNA, 31 bp, Artificial Sequence
  Description of Artificial Sequence:  Enzymatic Nucleic Acid
ggctctaaggctagctacaacgaatgtgtgt

SEQ ID NO: 3347 - DNA, 31 bp, Artificial Sequence
  Description of Artificial Sequence:  Enzymatic Nucleic Acid
cagaagggggctagctacaacgatctaacat

SEQ ID NO: 3348 - DNA, 31 bp, Artificial Sequence
  Description of Artificial Sequence:  Enzymatic Nucleic Acid
gcaggataggctagctacaacgatttttcag

SEQ ID NO: 3349 - DNA, 31 bp, Artificial Sequence
  Description of Artificial Sequence:  Enzymatic Nucleic Acid
aagcaggaggctagctacaacgaactttttc

SEQ ID NO: 3350 - DNA, 31 bp, Artificial Sequence
  Description of Artificial Sequence:  Enzymatic Nucleic Acid
atcagaagggctagctacaacgaaggatact

SEQ ID NO: 3351 - DNA, 31 bp, Artificial Sequence
  Description of Artificial Sequence:  Enzymatic Nucleic Acid
actgcataggctagctacaacgacagaagca

SEQ ID NO: 3352 - DNA, 31 bp, Artificial Sequence
  Description of Artificial Sequence:  Enzymatic Nucleic Acid
aaactgcaggctagctacaacgaatcagaag

SEQ ID NO: 3353 - DNA, 31 bp, Artificial Sequence
  Description of Artificial Sequence:  Enzymatic Nucleic Acid
gaaaactgggctagctacaacgaatatcaga

SEQ ID NO: 3354 - DNA, 31 bp, Artificial Sequence
  Description of Artificial Sequence:  Enzymatic Nucleic Acid
aaggaaaaggctagctacaacgatgcatatc

SEQ ID NO: 3355 - DNA, 31 bp, Artificial Sequence
  Description of Artificial Sequence:  Enzymatic Nucleic Acid
ttagataaggctagctacaacgattaaggaa

SEQ ID NO: 3356 - DNA, 31 bp, Artificial Sequence
  Description of Artificial Sequence:  Enzymatic Nucleic Acid
attttagaggctagctacaacgaaatttaag

SEQ ID NO: 3357 - DNA, 31 bp, Artificial Sequence
  Description of Artificial Sequence:  Enzymatic Nucleic Acid
ctagcagaggctagctacaacgatttagata

SEQ ID NO: 3358 - DNA, 31 bp, Artificial Sequence
  Description of Artificial Sequence:  Enzymatic Nucleic Acid
ttccctagggctagctacaacgaagatttta

SEQ ID NO: 3359 - DNA, 31 bp, Artificial Sequence
  Description of Artificial Sequence:  Enzymatic Nucleic Acid
tattgataggctagctacaacgatccctagc

SEQ ID NO: 3360 - DNA, 31 bp, Artificial Sequence
  Description of Artificial Sequence:  Enzymatic Nucleic Acid
tctattgaggctagctacaacgaattcccta

SEQ ID NO: 3361 - DNA, 31 bp, Artificial Sequence
  Description of Artificial Sequence:  Enzymatic Nucleic Acid
aatatctaggctagctacaacgatgatattc

SEQ ID NO: 3362 - DNA, 31 bp, Artificial Sequence
  Description of Artificial Sequence:  Enzymatic Nucleic Acid
ggtaaataggctagctacaacgactattgat

SEQ ID NO: 3363 - DNA, 31 bp, Artificial Sequence
  Description of Artificial Sequence:  Enzymatic Nucleic Acid
aaggtaaaggctagctacaacgaatctattg

SEQ ID NO: 3364 - DNA, 31 bp, Artificial Sequence
  Description of Artificial Sequence:  Enzymatic Nucleic Acid
ataaaaggggctagctacaacgaaaatatct

SEQ ID NO: 3365 - DNA, 31 bp, Artificial Sequence
  Description of Artificial Sequence:  Enzymatic Nucleic Acid
cattaaaaggctagctacaacgaaaaaggta

SEQ ID NO: 3366 - DNA, 31 bp, Artificial Sequence
  Description of Artificial Sequence:  Enzymatic Nucleic Acid
aggaaacaggctagctacaacgataaaataa

SEQ ID NO: 3367 - DNA, 31 bp, Artificial Sequence
  Description of Artificial Sequence:  Enzymatic Nucleic Acid
aaaggaaaggctagctacaacgaattaaaat

SEQ ID NO: 3368 - DNA, 31 bp, Artificial Sequence
  Description of Artificial Sequence:  Enzymatic Nucleic Acid
gtaaaaaaggctagctacaacgataaaggaa

SEQ ID NO: 3369 - DNA, 31 bp, Artificial Sequence
  Description of Artificial Sequence:  Enzymatic Nucleic Acid
aaaaatagggctagctacaacgaaaaaaatt

SEQ ID NO: 3370 - DNA, 31 bp, Artificial Sequence
  Description of Artificial Sequence:  Enzymatic Nucleic Acid
agtaaaaaggctagctacaacgaagtaaaaa

SEQ ID NO: 3371 - DNA, 31 bp, Artificial Sequence
  Description of Artificial Sequence:  Enzymatic Nucleic Acid
aagattagggctagctacaacgaaaaaatag

SEQ ID NO: 3372 - DNA, 31 bp, Artificial Sequence
  Description of Artificial Sequence:  Enzymatic Nucleic Acid
cagaaagaggctagctacaacgatagtaaaa

SEQ ID NO: 3373 - DNA, 31 bp, Artificial Sequence
  Description of Artificial Sequence:  Enzymatic Nucleic Acid
tgtttctgggctagctacaacgaagaaagat

SEQ ID NO: 3374 - DNA, 31 bp, Artificial Sequence
  Description of Artificial Sequence:  Enzymatic Nucleic Acid
cctttctgggctagctacaacgattctgcag

SEQ ID NO: 3375 - DNA, 31 bp, Artificial Sequence
  Description of Artificial Sequence:  Enzymatic Nucleic Acid
gaagaaaaggctagctacaacgactttctgt

SEQ ID NO: 3376 - DNA, 31 bp, Artificial Sequence
  Description of Artificial Sequence:  Enzymatic Nucleic Acid
ttttgaagggctagctacaacgaaaaaagaa

SEQ ID NO: 3377 - DNA, 31 bp, Artificial Sequence
  Description of Artificial Sequence:  Enzymatic Nucleic Acid
taagaatgggctagctacaacgattttgaag

SEQ ID NO: 3378 - DNA, 31 bp, Artificial Sequence
  Description of Artificial Sequence:  Enzymatic Nucleic Acid
tgtaagaaggctagctacaacgagtttttga

SEQ ID NO: 3379 - DNA, 31 bp, Artificial Sequence
  Description of Artificial Sequence:  Enzymatic Nucleic Acid
gtaaaatgggctagctacaacgaaagaatgt

SEQ ID NO: 3380 - DNA, 31 bp, Artificial Sequence
  Description of Artificial Sequence:  Enzymatic Nucleic Acid
aagtaaaaggctagctacaacgagtaagaat

SEQ ID NO: 3381 - DNA, 31 bp, Artificial Sequence
  Description of Artificial Sequence:  Enzymatic Nucleic Acid
ggaaaaagggctagctacaacgaaaaatgta

SEQ ID NO: 3382 - DNA, 31 bp, Artificial Sequence
  Description of Artificial Sequence:  Enzymatic Nucleic Acid
gagatgagggctagctacaacgacaggaaaa

SEQ ID NO: 3383 - DNA, 31 bp, Artificial Sequence
  Description of Artificial Sequence:  Enzymatic Nucleic Acid
taaagagaggctagctacaacgagagccagg

SEQ ID NO: 3384 - DNA, 31 bp, Artificial Sequence
  Description of Artificial Sequence:  Enzymatic Nucleic Acid
aaaaagaaggctagctacaacgaaaagagat

SEQ ID NO: 3385 - DNA, 31 bp, Artificial Sequence
  Description of Artificial Sequence:  Enzymatic Nucleic Acid
agactctgggctagctacaacgactttaaaa

SEQ ID NO: 3386 - DNA, 31 bp, Artificial Sequence
  Description of Artificial Sequence:  Enzymatic Nucleic Acid
gagcgagaggctagctacaacgatctgtctt

SEQ ID NO: 3387 - DNA, 31 bp, Artificial Sequence
  Description of Artificial Sequence:  Enzymatic Nucleic Acid
caacagagggctagctacaacgagagactct

SEQ ID NO: 3388 - DNA, 31 bp, Artificial Sequence
  Description of Artificial Sequence:  Enzymatic Nucleic Acid
ctgggcaaggctagctacaacgaagagcgag

SEQ ID NO: 3389 - DNA, 31 bp, Artificial Sequence
  Description of Artificial Sequence:  Enzymatic Nucleic Acid
agcctgggggctagctacaacgaaacagagc

SEQ ID NO: 3390 - DNA, 31 bp, Artificial Sequence
  Description of Artificial Sequence:  Enzymatic Nucleic Acid
cactccagggctagctacaacgactgggcaa

SEQ ID NO: 3391 - DNA, 31 bp, Artificial Sequence
  Description of Artificial Sequence:  Enzymatic Nucleic Acid
tcattgcaggctagctacaacgatccagcct

SEQ ID NO: 3392 - DNA, 31 bp, Artificial Sequence
  Description of Artificial Sequence:  Enzymatic Nucleic Acid
tgtcattgggctagctacaacgaactccagc

SEQ ID NO: 3393 - DNA, 31 bp, Artificial Sequence
  Description of Artificial Sequence:  Enzymatic Nucleic Acid
ctgtgtcaggctagctacaacgatgcactcc

SEQ ID NO: 3394 - DNA, 31 bp, Artificial Sequence
  Description of Artificial Sequence:  Enzymatic Nucleic Acid
agactgtgggctagctacaacgacattgcac

SEQ ID NO: 3395 - DNA, 31 bp, Artificial Sequence
  Description of Artificial Sequence:  Enzymatic Nucleic Acid
caagactgggctagctacaacgagtcattgc

SEQ ID NO: 3396 - DNA, 31 bp, Artificial Sequence
  Description of Artificial Sequence:  Enzymatic Nucleic Acid
agccaagaggctagctacaacgatgtgtcat

SEQ ID NO: 3397 - DNA, 31 bp, Artificial Sequence
  Description of Artificial Sequence:  Enzymatic Nucleic Acid
gcagtgagggctagctacaacgacaagactg

SEQ ID NO: 3398 - DNA, 31 bp, Artificial Sequence
  Description of Artificial Sequence:  Enzymatic Nucleic Acid
agttgcagggctagctacaacgagagccaag

SEQ ID NO: 3399 - DNA, 31 bp, Artificial Sequence
  Description of Artificial Sequence:  Enzymatic Nucleic Acid
agaagttgggctagctacaacgaagtgagcc

SEQ ID NO: 3400 - DNA, 31 bp, Artificial Sequence
  Description of Artificial Sequence:  Enzymatic Nucleic Acid
ggcagaagggctagctacaacgatgcagtga

SEQ ID NO: 3401 - DNA, 31 bp, Artificial Sequence
  Description of Artificial Sequence:  Enzymatic Nucleic Acid
ccaagaggggctagctacaacgaagaagttg

SEQ ID NO: 3402 - DNA, 31 bp, Artificial Sequence
  Description of Artificial Sequence:  Enzymatic Nucleic Acid
cacttgaaggctagctacaacgaccaagagg

SEQ ID NO: 3403 - DNA, 31 bp, Artificial Sequence
  Description of Artificial Sequence:  Enzymatic Nucleic Acid
gagaatcaggctagctacaacgattgaaccc

SEQ ID NO: 3404 - DNA, 31 bp, Artificial Sequence
  Description of Artificial Sequence:  Enzymatic Nucleic Acid
caggagaaggctagctacaacgacacttgaa

SEQ ID NO: 3405 - DNA, 31 bp, Artificial Sequence
  Description of Artificial Sequence:  Enzymatic Nucleic Acid
ggctgaggggctagctacaacgaaggagaat

SEQ ID NO: 3406 - DNA, 31 bp, Artificial Sequence
  Description of Artificial Sequence:  Enzymatic Nucleic Acid
tcaggaggggctagctacaacgatgaggcag

SEQ ID NO: 3407 - DNA, 31 bp, Artificial Sequence
  Description of Artificial Sequence:  Enzymatic Nucleic Acid
tccagctaggctagctacaacgatcaggagg

SEQ ID NO: 3408 - DNA, 31 bp, Artificial Sequence
  Description of Artificial Sequence:  Enzymatic Nucleic Acid
taatccagggctagctacaacgatactcagg

SEQ ID NO: 3409 - DNA, 31 bp, Artificial Sequence
  Description of Artificial Sequence:  Enzymatic Nucleic Acid
gcctgtaaggctagctacaacgaccagctac

SEQ ID NO: 3410 - DNA, 31 bp, Artificial Sequence
  Description of Artificial Sequence:  Enzymatic Nucleic Acid
catgcctgggctagctacaacgaaatccagc

SEQ ID NO: 3411 - DNA, 31 bp, Artificial Sequence
  Description of Artificial Sequence:  Enzymatic Nucleic Acid
ggcacatgggctagctacaacgactgtaatc

SEQ ID NO: 3412 - DNA, 31 bp, Artificial Sequence
  Description of Artificial Sequence:  Enzymatic Nucleic Acid
gtggcacaggctagctacaacgagcctgtaa

SEQ ID NO: 3413 - DNA, 31 bp, Artificial Sequence
  Description of Artificial Sequence:  Enzymatic Nucleic Acid
gggtggcaggctagctacaacgaatgcctgt

SEQ ID NO: 3414 - DNA, 31 bp, Artificial Sequence
  Description of Artificial Sequence:  Enzymatic Nucleic Acid
gtgggtggggctagctacaacgaacatgcct

SEQ ID NO: 3415 - DNA, 31 bp, Artificial Sequence
  Description of Artificial Sequence:  Enzymatic Nucleic Acid
tgggtgggggctagctacaacgaggcacatg

SEQ ID NO: 3416 - DNA, 31 bp, Artificial Sequence
  Description of Artificial Sequence:  Enzymatic Nucleic Acid
tagttgggggctagctacaacgagggtggca

SEQ ID NO: 3417 - DNA, 31 bp, Artificial Sequence
  Description of Artificial Sequence:  Enzymatic Nucleic Acid
aaaattagggctagctacaacgatgggtggg

SEQ ID NO: 3418 - DNA, 31 bp, Artificial Sequence
  Description of Artificial Sequence:  Enzymatic Nucleic Acid
cacaaaaaggctagctacaacgatagttggg

SEQ ID NO: 3419 - DNA, 31 bp, Artificial Sequence
  Description of Artificial Sequence:  Enzymatic Nucleic Acid
taaaaacaggctagctacaacgaaaaaatta

SEQ ID NO: 3420 - DNA, 31 bp, Artificial Sequence
  Description of Artificial Sequence:  Enzymatic Nucleic Acid
attaaaaaggctagctacaacgaacaaaaat

SEQ ID NO: 3421 - DNA, 31 bp, Artificial Sequence
  Description of Artificial Sequence:  Enzymatic Nucleic Acid
tgtctttaggctagctacaacgataaaaaca

SEQ ID NO: 3422 - DNA, 31 bp, Artificial Sequence
  Description of Artificial Sequence:  Enzymatic Nucleic Acid
aaaccctgggctagctacaacgactttatta

SEQ ID NO: 3423 - DNA, 31 bp, Artificial Sequence
  Description of Artificial Sequence:  Enzymatic Nucleic Acid
tggtgaaaggctagctacaacgacctgtctt

SEQ ID NO: 3424 - DNA, 31 bp, Artificial Sequence
  Description of Artificial Sequence:  Enzymatic Nucleic Acid
caacatggggctagctacaacgagaaaccct

SEQ ID NO: 3425 - DNA, 31 bp, Artificial Sequence
  Description of Artificial Sequence:  Enzymatic Nucleic Acid
ggccaacaggctagctacaacgaggtgaaac

SEQ ID NO: 3426 - DNA, 31 bp, Artificial Sequence
  Description of Artificial Sequence:  Enzymatic Nucleic Acid
ctggccaaggctagctacaacgaatggtgaa

SEQ ID NO: 3427 - DNA, 31 bp, Artificial Sequence
  Description of Artificial Sequence:  Enzymatic Nucleic Acid
cagcctggggctagctacaacgacaacatgg

SEQ ID NO: 3428 - DNA, 31 bp, Artificial Sequence
  Description of Artificial Sequence:  Enzymatic Nucleic Acid
gagaccagggctagctacaacgactggccaa

SEQ ID NO: 3429 - DNA, 31 bp, Artificial Sequence
  Description of Artificial Sequence:  Enzymatic Nucleic Acid
gtttgagaggctagctacaacgacagcctgg

SEQ ID NO: 3430 - DNA, 31 bp, Artificial Sequence
  Description of Artificial Sequence:  Enzymatic Nucleic Acid
gtcaggagggctagctacaacgattgagacc

SEQ ID NO: 3431 - DNA, 31 bp, Artificial Sequence
  Description of Artificial Sequence:  Enzymatic Nucleic Acid
acttgaggggctagctacaacgacaggagtt

SEQ ID NO: 3432 - DNA, 31 bp, Artificial Sequence
  Description of Artificial Sequence:  Enzymatic Nucleic Acid
gtggattaggctagctacaacgattgaggtc

SEQ ID NO: 3433 - DNA, 31 bp, Artificial Sequence
  Description of Artificial Sequence:  Enzymatic Nucleic Acid
caggtggaggctagctacaacgatacttgag

SEQ ID NO: 3434 - DNA, 31 bp, Artificial Sequence
  Description of Artificial Sequence:  Enzymatic Nucleic Acid
gaggcaggggctagctacaacgaggattact

SEQ ID NO: 3435 - DNA, 31 bp, Artificial Sequence
  Description of Artificial Sequence:  Enzymatic Nucleic Acid
ggccgaggggctagctacaacgaaggtggat

SEQ ID NO: 3436 - DNA, 31 bp, Artificial Sequence
  Description of Artificial Sequence:  Enzymatic Nucleic Acid
ttgggaggggctagctacaacgacgaggcag

SEQ ID NO: 3437 - DNA, 31 bp, Artificial Sequence
  Description of Artificial Sequence:  Enzymatic Nucleic Acid
tcccagcaggctagctacaacgatttgggag

SEQ ID NO: 3438 - DNA, 31 bp, Artificial Sequence
  Description of Artificial Sequence:  Enzymatic Nucleic Acid
aatcccagggctagctacaacgaactttggg

SEQ ID NO: 3439 - DNA, 31 bp, Artificial Sequence
  Description of Artificial Sequence:  Enzymatic Nucleic Acid
ccctgtaaggctagctacaacgacccagcac

SEQ ID NO: 3440 - DNA, 31 bp, Artificial Sequence
  Description of Artificial Sequence:  Enzymatic Nucleic Acid
catccctgggctagctacaacgaaatcccag

SEQ ID NO: 3441 - DNA, 31 bp, Artificial Sequence
  Description of Artificial Sequence:  Enzymatic Nucleic Acid
gtggctcaggctagctacaacgaccctgtaa

SEQ ID NO: 3442 - DNA, 31 bp, Artificial Sequence
  Description of Artificial Sequence:  Enzymatic Nucleic Acid
cgcggtggggctagctacaacgatcatccct

SEQ ID NO: 3443 - DNA, 31 bp, Artificial Sequence
  Description of Artificial Sequence:  Enzymatic Nucleic Acid
gggcgcggggctagctacaacgaggctcatc

SEQ ID NO: 3444 - DNA, 31 bp, Artificial Sequence
  Description of Artificial Sequence:  Enzymatic Nucleic Acid
gctgggcgggctagctacaacgaggtggctc

SEQ ID NO: 3445 - DNA, 31 bp, Artificial Sequence
  Description of Artificial Sequence:  Enzymatic Nucleic Acid
aggctgggggctagctacaacgagcggtggc

SEQ ID NO: 3446 - DNA, 31 bp, Artificial Sequence
  Description of Artificial Sequence:  Enzymatic Nucleic Acid
agatgaggggctagctacaacgatgggcgcg

SEQ ID NO: 3447 - DNA, 31 bp, Artificial Sequence
  Description of Artificial Sequence:  Enzymatic Nucleic Acid
caaagagaggctagctacaacgagaggctgg

SEQ ID NO: 3448 - DNA, 31 bp, Artificial Sequence
  Description of Artificial Sequence:  Enzymatic Nucleic Acid
ctttagaaggctagctacaacgaaaagagat

SEQ ID NO: 3449 - DNA, 31 bp, Artificial Sequence
  Description of Artificial Sequence:  Enzymatic Nucleic Acid
tttttccaggctagctacaacgactttagaa

SEQ ID NO: 3450 - DNA, 31 bp, Artificial Sequence
  Description of Artificial Sequence:  Enzymatic Nucleic Acid
gggggtggggctagctacaacgattttccat

SEQ ID NO: 3451 - DNA, 31 bp, Artificial Sequence
  Description of Artificial Sequence:  Enzymatic Nucleic Acid
tttgggggggctagctacaacgaggtttttc

SEQ ID NO: 3452 - DNA, 31 bp, Artificial Sequence
  Description of Artificial Sequence:  Enzymatic Nucleic Acid
aaagaaaaggctagctacaacgattgggggt

SEQ ID NO: 3453 - DNA, 31 bp, Artificial Sequence
  Description of Artificial Sequence:  Enzymatic Nucleic Acid
taatagtaggctagctacaacgaaaaaagaa

SEQ ID NO: 3454 - DNA, 31 bp, Artificial Sequence
  Description of Artificial Sequence:  Enzymatic Nucleic Acid
attaatagggctagctacaacgaataaaaag

SEQ ID NO: 3455 - DNA, 31 bp, Artificial Sequence
  Description of Artificial Sequence:  Enzymatic Nucleic Acid
ttcattaaggctagctacaacgaagtataaa

SEQ ID NO: 3456 - DNA, 31 bp, Artificial Sequence
  Description of Artificial Sequence:  Enzymatic Nucleic Acid
ttgattcaggctagctacaacgataatagta

SEQ ID NO: 3457 - DNA, 31 bp, Artificial Sequence
  Description of Artificial Sequence:  Enzymatic Nucleic Acid
ttgattgaggctagctacaacgatcattaat

SEQ ID NO: 3458 - DNA, 31 bp, Artificial Sequence
  Description of Artificial Sequence:  Enzymatic Nucleic Acid
tgaattgaggctagctacaacgatgattcat

SEQ ID NO: 3459 - DNA, 31 bp, Artificial Sequence
  Description of Artificial Sequence:  Enzymatic Nucleic Acid
gatatgaaggctagctacaacgatgattgat

SEQ ID NO: 3460 - DNA, 31 bp, Artificial Sequence
  Description of Artificial Sequence:  Enzymatic Nucleic Acid
aatagataggctagctacaacgagaattgat

SEQ ID NO: 3461 - DNA, 31 bp, Artificial Sequence
  Description of Artificial Sequence:  Enzymatic Nucleic Acid
taaatagaggctagctacaacgaatgaattg

SEQ ID NO: 3462 - DNA, 31 bp, Artificial Sequence
  Description of Artificial Sequence:  Enzymatic Nucleic Acid
ttaataaaggctagctacaacgaagatatga

SEQ ID NO: 3463 - DNA, 31 bp, Artificial Sequence
  Description of Artificial Sequence:  Enzymatic Nucleic Acid
aaatttaaggctagctacaacgaaaatagat

SEQ ID NO: 3464 - DNA, 31 bp, Artificial Sequence
  Description of Artificial Sequence:  Enzymatic Nucleic Acid
ggtagaaaggctagctacaacgattaataaa

SEQ ID NO: 3465 - DNA, 31 bp, Artificial Sequence
  Description of Artificial Sequence:  Enzymatic Nucleic Acid
aaaagcggggctagctacaacgaagaaattt

SEQ ID NO: 3466 - DNA, 31 bp, Artificial Sequence
  Description of Artificial Sequence:  Enzymatic Nucleic Acid
cctaaaagggctagctacaacgaggtagaaa

SEQ ID NO: 3467 - DNA, 31 bp, Artificial Sequence
  Description of Artificial Sequence:  Enzymatic Nucleic Acid
ttttttggggctagctacaacgactaaaagc

SEQ ID NO: 3468 - DNA, 31 bp, Artificial Sequence
  Description of Artificial Sequence:  Enzymatic Nucleic Acid
atcttacaggctagctacaacgattttttgg

SEQ ID NO: 3469 - DNA, 31 bp, Artificial Sequence
  Description of Artificial Sequence:  Enzymatic Nucleic Acid
cgatcttaggctagctacaacgaattttttt

SEQ ID NO: 3470 - DNA, 31 bp, Artificial Sequence
  Description of Artificial Sequence:  Enzymatic Nucleic Acid
gagaacgaggctagctacaacgacttacatt

SEQ ID NO: 3471 - DNA, 31 bp, Artificial Sequence
  Description of Artificial Sequence:  Enzymatic Nucleic Acid
gcagagaaggctagctacaacgagatcttac

SEQ ID NO: 3472 - DNA, 31 bp, Artificial Sequence
  Description of Artificial Sequence:  Enzymatic Nucleic Acid
atgtgaggggctagctacaacgaagagaacg

SEQ ID NO: 3473 - DNA, 31 bp, Artificial Sequence
  Description of Artificial Sequence:  Enzymatic Nucleic Acid
aagctatgggctagctacaacgagaggcaga

SEQ ID NO: 3474 - DNA, 31 bp, Artificial Sequence
  Description of Artificial Sequence:  Enzymatic Nucleic Acid
gtaagctaggctagctacaacgagtgaggca

SEQ ID NO: 3475 - DNA, 31 bp, Artificial Sequence
  Description of Artificial Sequence:  Enzymatic Nucleic Acid
cttgtaagggctagctacaacgatatgtgag

SEQ ID NO: 3476 - DNA, 31 bp, Artificial Sequence
  Description of Artificial Sequence:  Enzymatic Nucleic Acid
ctggcttgggctagctacaacgaaagctatg

SEQ ID NO: 3477 - DNA, 31 bp, Artificial Sequence
  Description of Artificial Sequence:  Enzymatic Nucleic Acid
ccagctggggctagctacaacgattgtaagc

SEQ ID NO: 3478 - DNA, 31 bp, Artificial Sequence
  Description of Artificial Sequence:  Enzymatic Nucleic Acid
ttctccagggctagctacaacgatggcttgt

SEQ ID NO: 3479 - DNA, 31 bp, Artificial Sequence
  Description of Artificial Sequence:  Enzymatic Nucleic Acid
gtaccataggctagctacaacgattctccag

SEQ ID NO: 3480 - DNA, 31 bp, Artificial Sequence
  Description of Artificial Sequence:  Enzymatic Nucleic Acid
gagtaccaggctagctacaacgaatttctcc

SEQ ID NO: 3481 - DNA, 31 bp, Artificial Sequence
  Description of Artificial Sequence:  Enzymatic Nucleic Acid
aatgagtaggctagctacaacgacatatttc

SEQ ID NO: 3482 - DNA, 31 bp, Artificial Sequence
  Description of Artificial Sequence:  Enzymatic Nucleic Acid
ttaatgagggctagctacaacgaaccatatt

SEQ ID NO: 3483 - DNA, 31 bp, Artificial Sequence
  Description of Artificial Sequence:  Enzymatic Nucleic Acid
ttttttaaggctagctacaacgagagtacca

SEQ ID NO: 3484 - DNA, 31 bp, Artificial Sequence
  Description of Artificial Sequence:  Enzymatic Nucleic Acid
gtacatcaggctagctacaacgatttttttt

SEQ ID NO: 3485 - DNA, 31 bp, Artificial Sequence
  Description of Artificial Sequence:  Enzymatic Nucleic Acid
gttgtacaggctagctacaacgacacttttt

SEQ ID NO: 3486 - RNA, 17 nt, Homo sapiens
gcggcggcggcggcgca

SEQ ID NO: 3487 - RNA, 17 nt, Homo sapiens
gcggcggcggcgcaguu

SEQ ID NO: 3488 - RNA, 17 nt, Homo sapiens
uacuuugugacuugcgg

SEQ ID NO: 3489 - RNA, 17 nt, Homo sapiens
ugacuugcggucacagu

SEQ ID NO: 3490 - RNA, 17 nt, Homo sapiens
gucacaguggcauucag

SEQ ID NO: 3491 - RNA, 17 nt, Homo sapiens
ccacacuugguagaacc

SEQ ID NO: 3492 - RNA, 17 nt, Homo sapiens
acuugguagaaccacag

SEQ ID NO: 3493 - RNA, 17 nt, Homo sapiens
gaaccacaggcacgaca

SEQ ID NO: 3494 - RNA, 17 nt, Homo sapiens
acaggcacgacaagcau

SEQ ID NO: 3495 - RNA, 17 nt, Homo sapiens
caagcauagaaacaucc

SEQ ID NO: 3496 - RNA, 17 nt, Homo sapiens
ucuucaucgaggcaucg

SEQ ID NO: 3497 - RNA, 17 nt, Homo sapiens
uucaucgaggcaucgag

SEQ ID NO: 3498 - RNA, 17 nt, Homo sapiens
gaggcaucgagguccau

SEQ ID NO: 3499 - RNA, 17 nt, Homo sapiens
ggcaucgagguccaucc

SEQ ID NO: 3500 - RNA, 17 nt, Homo sapiens
aaaaaucaggagacccu

SEQ ID NO: 3501 - RNA, 17 nt, Homo sapiens
aaaaucaggagacccug

SEQ ID NO: 3502 - RNA, 17 nt, Homo sapiens
aaucaggagacccuggc

SEQ ID NO: 3503 - RNA, 17 nt, Homo sapiens
gagacccuggcuaucau

SEQ ID NO: 3504 - RNA, 17 nt, Homo sapiens
cuaucauagaccuuagu

SEQ ID NO: 3505 - RNA, 17 nt, Homo sapiens
ucuucgcugguauacuc

SEQ ID NO: 3506 - RNA, 17 nt, Homo sapiens
caaccagcgguugacuu

SEQ ID NO: 3507 - RNA, 17 nt, Homo sapiens
cagcgguugacuuuuuu

SEQ ID NO: 3508 - RNA, 17 nt, Homo sapiens
caguuucuggagcaaau

SEQ ID NO: 3509 - RNA, 17 nt, Homo sapiens
aguuucuggagcaaauu

SEQ ID NO: 3510 - RNA, 17 nt, Homo sapiens
gccuuccuggauuugua

SEQ ID NO: 3511 - RNA, 17 nt, Homo sapiens
ccuuccuggauuuguaa

SEQ ID NO: 3512 - RNA, 17 nt, Homo sapiens
auuguaaugaccucaaa

SEQ ID NO: 3513 - RNA, 17 nt, Homo sapiens
uuccaucugacucaggu

SEQ ID NO: 3514 - RNA, 17 nt, Homo sapiens
cugacucagguuugcuu

SEQ ID NO: 3515 - RNA, 17 nt, Homo sapiens
gcuucucuggcggucuu

SEQ ID NO: 3516 - RNA, 17 nt, Homo sapiens
ucucuggcggucuucag

SEQ ID NO: 3517 - RNA, 17 nt, Homo sapiens
ggucuucagaaucaaca

SEQ ID NO: 3518 - RNA, 17 nt, Homo sapiens
acuuccgugauuaucug

SEQ ID NO: 3519 - RNA, 17 nt, Homo sapiens
ugcauuuuggacaaagc

SEQ ID NO: 3520 - RNA, 17 nt, Homo sapiens
gcauuuuggacaaagcu

SEQ ID NO: 3521 - RNA, 17 nt, Homo sapiens
uccaaccaggauacggg

SEQ ID NO: 3522 - RNA, 17 nt, Homo sapiens
ccaaccaggauacggga

SEQ ID NO: 3523 - RNA, 17 nt, Homo sapiens
caggauacgggaagaag

SEQ ID NO: 3524 - RNA, 17 nt, Homo sapiens
aggauacgggaagaaga

SEQ ID NO: 3525 - RNA, 17 nt, Homo sapiens
ggauacgggaagaagaa

SEQ ID NO: 3526 - RNA, 17 nt, Homo sapiens
uacgggaagaagaaaug

SEQ ID NO: 3527 - RNA, 17 nt, Homo sapiens
gggaagaagaaauggcu

SEQ ID NO: 3528 - RNA, 17 nt, Homo sapiens
gaagaaauggcugguga

SEQ ID NO: 3529 - RNA, 17 nt, Homo sapiens
aaauggcuggugaucuu

SEQ ID NO: 3530 - RNA, 17 nt, Homo sapiens
uggcuggugaucuuuca

SEQ ID NO: 3531 - RNA, 17 nt, Homo sapiens
uuucagcagguuucuuc

SEQ ID NO: 3532 - RNA, 17 nt, Homo sapiens
uucuucauggaggaacu

SEQ ID NO: 3533 - RNA, 17 nt, Homo sapiens
ucuucauggaggaacuu

SEQ ID NO: 3534 - RNA, 17 nt, Homo sapiens
uucauggaggaacuuaa

SEQ ID NO: 3535 - RNA, 17 nt, Homo sapiens
ucauggaggaacuuaau

SEQ ID NO: 3536 - RNA, 17 nt, Homo sapiens
uaccgucagaagcaggg

SEQ ID NO: 3537 - RNA, 17 nt, Homo sapiens
cagaagcagggaguagu

SEQ ID NO: 3538 - RNA, 17 nt, Homo sapiens
agaagcagggaguagua

SEQ ID NO: 3539 - RNA, 17 nt, Homo sapiens
gaagcagggaguaguac

SEQ ID NO: 3540 - RNA, 17 nt, Homo sapiens
aauaucaagaacugccu

SEQ ID NO: 3541 - RNA, 17 nt, Homo sapiens
cuaauucaggaccucca

SEQ ID NO: 3542 - RNA, 17 nt, Homo sapiens
uaauucaggaccuccac

SEQ ID NO: 3543 - RNA, 17 nt, Homo sapiens
cuccacaugauaggagg

SEQ ID NO: 3544 - RNA, 17 nt, Homo sapiens
acaugauaggagguuua

SEQ ID NO: 3545 - RNA, 17 nt, Homo sapiens
caugauaggagguuuac

SEQ ID NO: 3546 - RNA, 17 nt, Homo sapiens
ugauaggagguuuacau

SEQ ID NO: 3547 - RNA, 17 nt, Homo sapiens
uuauaauagauggaaga

SEQ ID NO: 3548 - RNA, 17 nt, Homo sapiens
uaauagauggaagagaa

SEQ ID NO: 3549 - RNA, 17 nt, Homo sapiens
aauagauggaagagaau

SEQ ID NO: 3550 - RNA, 17 nt, Homo sapiens
agauggaagagaauuuc

SEQ ID NO: 3551 - RNA, 17 nt, Homo sapiens
auggaagagaauuucca

SEQ ID NO: 3552 - RNA, 17 nt, Homo sapiens
aauuuccagaaggugaa

SEQ ID NO: 3553 - RNA, 17 nt, Homo sapiens
uuccagaaggugaaggu

SEQ ID NO: 3554 - RNA, 17 nt, Homo sapiens
cagaaggugaagguaga

SEQ ID NO: 3555 - RNA, 17 nt, Homo sapiens
aaggugaagguagauca

SEQ ID NO: 3556 - RNA, 17 nt, Homo sapiens
ugaagguagaucaaaga

SEQ ID NO: 3557 - RNA, 17 nt, Homo sapiens
agaucaaagaaggaagc

SEQ ID NO: 3558 - RNA, 17 nt, Homo sapiens
ucaaagaaggaagcaaa

SEQ ID NO: 3559 - RNA, 17 nt, Homo sapiens
caaagaaggaagcaaaa

SEQ ID NO: 3560 - RNA, 17 nt, Homo sapiens
uagcuguugagauacuu

SEQ ID NO: 3561 - RNA, 17 nt, Homo sapiens
gcuguugagauacuuaa

SEQ ID NO: 3562 - RNA, 17 nt, Homo sapiens
cuuaauaaggaaaagaa

SEQ ID NO: 3563 - RNA, 17 nt, Homo sapiens
uuaauaaggaaaagaag

SEQ ID NO: 3564 - RNA, 17 nt, Homo sapiens
aaggaaaagaaggcagu

SEQ ID NO: 3565 - RNA, 17 nt, Homo sapiens
gaaaagaaggcaguuag

SEQ ID NO: 3566 - RNA, 17 nt, Homo sapiens
uuauuauugacaacaac

SEQ ID NO: 3567 - RNA, 17 nt, Homo sapiens
acaacaacgaauucuuc

SEQ ID NO: 3568 - RNA, 17 nt, Homo sapiens
auucuucagaaggauua

SEQ ID NO: 3569 - RNA, 17 nt, Homo sapiens
cuucagaaggauuaucc

SEQ ID NO: 3570 - RNA, 17 nt, Homo sapiens
uucagaaggauuaucca

SEQ ID NO: 3571 - RNA, 17 nt, Homo sapiens
uuauccauggggaauua

SEQ ID NO: 3572 - RNA, 17 nt, Homo sapiens
uauccauggggaauuac

SEQ ID NO: 3573 - RNA, 17 nt, Homo sapiens
auccauggggaauuaca

SEQ ID NO: 3574 - RNA, 17 nt, Homo sapiens
uccauggggaauuacau

SEQ ID NO: 3575 - RNA, 17 nt, Homo sapiens
auuacauaggccuuauc

SEQ ID NO: 3576 - RNA, 17 nt, Homo sapiens
uaucaauagaauugccc

SEQ ID NO: 3577 - RNA, 17 nt, Homo sapiens
auugcccagaagaaaag

SEQ ID NO: 3578 - RNA, 17 nt, Homo sapiens
gcccagaagaaaagacu

SEQ ID NO: 3579 - RNA, 17 nt, Homo sapiens
gaagaaaagacuaacug

SEQ ID NO: 3580 - RNA, 17 nt, Homo sapiens
uaaauuaugaacagugu

SEQ ID NO: 3581 - RNA, 17 nt, Homo sapiens
ugugcaucgggggugca

SEQ ID NO: 3582 - RNA, 17 nt, Homo sapiens
gugcaucgggggugcau

SEQ ID NO: 3583 - RNA, 17 nt, Homo sapiens
ugcaucgggggugcaug

SEQ ID NO: 3584 - RNA, 17 nt, Homo sapiens
gcaucgggggugcaugg

SEQ ID NO: 3585 - RNA, 17 nt, Homo sapiens
gggugcaugggccagaa

SEQ ID NO: 3586 - RNA, 17 nt, Homo sapiens
ggugcaugggccagaag

SEQ ID NO: 3587 - RNA, 17 nt, Homo sapiens
augggccagaaggauuu

SEQ ID NO: 3588 - RNA, 17 nt, Homo sapiens
ggccagaaggauuucau

SEQ ID NO: 3589 - RNA, 17 nt, Homo sapiens
gccagaaggauuucauu

SEQ ID NO: 3590 - RNA, 17 nt, Homo sapiens
ugcaaaaugggacagaa

SEQ ID NO: 3591 - RNA, 17 nt, Homo sapiens
gcaaaaugggacagaaa

SEQ ID NO: 3592 - RNA, 17 nt, Homo sapiens
caaaaugggacagaaag

SEQ ID NO: 3593 - RNA, 17 nt, Homo sapiens
augggacagaaagaaua

SEQ ID NO: 3594 - RNA, 17 nt, Homo sapiens
gacagaaagaauauagu

SEQ ID NO: 3595 - RNA, 17 nt, Homo sapiens
auaguauugguacaggu

SEQ ID NO: 3596 - RNA, 17 nt, Homo sapiens
uugguacagguucuacu

SEQ ID NO: 3597 - RNA, 17 nt, Homo sapiens
acuaaacaggaagcaaa

SEQ ID NO: 3598 - RNA, 17 nt, Homo sapiens
cuaaacaggaagcaaaa

SEQ ID NO: 3599 - RNA, 17 nt, Homo sapiens
aaacaauuggccgcuaa

SEQ ID NO: 3600 - RNA, 17 nt, Homo sapiens
uaucuucagauauuauc

SEQ ID NO: 3601 - RNA, 17 nt, Homo sapiens
uauuaucagaagaaacc

SEQ ID NO: 3602 - RNA, 17 nt, Homo sapiens
uaucagaagaaaccuca

SEQ ID NO: 3603 - RNA, 17 nt, Homo sapiens
accucagugaaaucuga

SEQ ID NO: 3604 - RNA, 17 nt, Homo sapiens
ugaaaucugacuaccug

SEQ ID NO: 3605 - RNA, 17 nt, Homo sapiens
uguccucugguucuuuu

SEQ ID NO: 3606 - RNA, 17 nt, Homo sapiens
cuacgugugagucccaa

SEQ ID NO: 3607 - RNA, 17 nt, Homo sapiens
ucuuuagugaccagcac

SEQ ID NO: 3608 - RNA, 17 nt, Homo sapiens
ucgcuucugaaucauca

SEQ ID NO: 3609 - RNA, 17 nt, Homo sapiens
caucaucugaaggugac

SEQ ID NO: 3610 - RNA, 17 nt, Homo sapiens
caucugaaggugacuuc

SEQ ID NO: 3611 - RNA, 17 nt, Homo sapiens
cugaaggugacuucuca

SEQ ID NO: 3612 - RNA, 17 nt, Homo sapiens
ucucagcagauacauca

SEQ ID NO: 3613 - RNA, 17 nt, Homo sapiens
auacaucagagauaaau

SEQ ID NO: 3614 - RNA, 17 nt, Homo sapiens
acaucagagauaaauuc

SEQ ID NO: 3615 - RNA, 17 nt, Homo sapiens
cuaacagugacaguuua

SEQ ID NO: 3616 - RNA, 17 nt, Homo sapiens
uugcuuaugaauggucu

SEQ ID NO: 3617 - RNA, 17 nt, Homo sapiens
uuaugaauggucucaga

SEQ ID NO: 3618 - RNA, 17 nt, Homo sapiens
uggucucagaaauaauc

SEQ ID NO: 3619 - RNA, 17 nt, Homo sapiens
uaaucaaaggaaggcaa

SEQ ID NO: 3620 - RNA, 17 nt, Homo sapiens
aaucaaaggaaggcaaa

SEQ ID NO: 3621 - RNA, 17 nt, Homo sapiens
caaaggaaggcaaaaag

SEQ ID NO: 3622 - RNA, 17 nt, Homo sapiens
ggcaaaaagaucuuugg

SEQ ID NO: 3623 - RNA, 17 nt, Homo sapiens
agaucuuuggcacccag

SEQ ID NO: 3624 - RNA, 17 nt, Homo sapiens
ggcacccagauuugacc

SEQ ID NO: 3625 - RNA, 17 nt, Homo sapiens
ccagauuugaccuuccu

SEQ ID NO: 3626 - RNA, 17 nt, Homo sapiens
accuuccugacaugaaa

SEQ ID NO: 3627 - RNA, 17 nt, Homo sapiens
ccugacaugaaagaaac

SEQ ID NO: 3628 - RNA, 17 nt, Homo sapiens
acaugaaagaaacaaag

SEQ ID NO: 3629 - RNA, 17 nt, Homo sapiens
uauacuguggacaagag

SEQ ID NO: 3630 - RNA, 17 nt, Homo sapiens
auacuguggacaagagg

SEQ ID NO: 3631 - RNA, 17 nt, Homo sapiens
guggacaagagguuugg

SEQ ID NO: 3632 - RNA, 17 nt, Homo sapiens
ggacaagagguuuggca

SEQ ID NO: 3633 - RNA, 17 nt, Homo sapiens
agagguuuggcauggau

SEQ ID NO: 3634 - RNA, 17 nt, Homo sapiens
uuuggcauggauuuuaa

SEQ ID NO: 3635 - RNA, 17 nt, Homo sapiens
uuggcauggauuuuaaa

SEQ ID NO: 3636 - RNA, 17 nt, Homo sapiens
auuuuaaagaaauagaa

SEQ ID NO: 3637 - RNA, 17 nt, Homo sapiens
aagaaauagaauuaauu

SEQ ID NO: 3638 - RNA, 17 nt, Homo sapiens
aauuaauuggcucaggu

SEQ ID NO: 3639 - RNA, 17 nt, Homo sapiens
uuggcucagguggauuu

SEQ ID NO: 3640 - RNA, 17 nt, Homo sapiens
gcucagguggauuuggc

SEQ ID NO: 3641 - RNA, 17 nt, Homo sapiens
cucagguggauuuggcc

SEQ ID NO: 3642 - RNA, 17 nt, Homo sapiens
guggauuuggccaaguu

SEQ ID NO: 3643 - RNA, 17 nt, Homo sapiens
aaaacacagaauugacg

SEQ ID NO: 3644 - RNA, 17 nt, Homo sapiens
acagaauugacggaaag

SEQ ID NO: 3645 - RNA, 17 nt, Homo sapiens
gaauugacggaaagacu

SEQ ID NO: 3646 - RNA, 17 nt, Homo sapiens
aauugacggaaagacuu

SEQ ID NO: 3647 - RNA, 17 nt, Homo sapiens
gacggaaagacuuacgu

SEQ ID NO: 3648 - RNA, 17 nt, Homo sapiens
auaauaacgagaaggcg

SEQ ID NO: 3649 - RNA, 17 nt, Homo sapiens
aauaacgagaaggcgga

SEQ ID NO: 3650 - RNA, 17 nt, Homo sapiens
aacgagaaggcggagcg

SEQ ID NO: 3651 - RNA, 17 nt, Homo sapiens
gagaaggcggagcguga

SEQ ID NO: 3652 - RNA, 17 nt, Homo sapiens
agaaggcggagcgugaa

SEQ ID NO: 3653 - RNA, 17 nt, Homo sapiens
cggagcgugaaguaaaa

SEQ ID NO: 3654 - RNA, 17 nt, Homo sapiens
aaagcauuggcaaaacu

SEQ ID NO: 3655 - RNA, 17 nt, Homo sapiens
caaaacuugaucaugua

SEQ ID NO: 3656 - RNA, 17 nt, Homo sapiens
acuacaauggcuguugg

SEQ ID NO: 3657 - RNA, 17 nt, Homo sapiens
uggcuguugggauggau

SEQ ID NO: 3658 - RNA, 17 nt, Homo sapiens
ggcuguugggauggauu

SEQ ID NO: 3659 - RNA, 17 nt, Homo sapiens
gcuguugggauggauuu

SEQ ID NO: 3660 - RNA, 17 nt, Homo sapiens
guugggauggauuugau

SEQ ID NO: 3661 - RNA, 17 nt, Homo sapiens
uugggauggauuugauu

SEQ ID NO: 3662 - RNA, 17 nt, Homo sapiens
auggauuugauuaugau

SEQ ID NO: 3663 - RNA, 17 nt, Homo sapiens
uugauuaugauccugag

SEQ ID NO: 3664 - RNA, 17 nt, Homo sapiens
augauccugagaccagu

SEQ ID NO: 3665 - RNA, 17 nt, Homo sapiens
gauccugagaccaguga

SEQ ID NO: 3666 - RNA, 17 nt, Homo sapiens
agaccagugaugauucu

SEQ ID NO: 3667 - RNA, 17 nt, Homo sapiens
ccagugaugauucucuu

SEQ ID NO: 3668 - RNA, 17 nt, Homo sapiens
auucucuugagagcagu

SEQ ID NO: 3669 - RNA, 17 nt, Homo sapiens
ucucuugagagcaguga

SEQ ID NO: 3670 - RNA, 17 nt, Homo sapiens
agagcagugauuaugau

SEQ ID NO: 3671 - RNA, 17 nt, Homo sapiens
gugauuaugauccugag

SEQ ID NO: 3672 - RNA, 17 nt, Homo sapiens
augauccugagaacagc

SEQ ID NO: 3673 - RNA, 17 nt, Homo sapiens
gauccugagaacagcaa

SEQ ID NO: 3674 - RNA, 17 nt, Homo sapiens
uaguucaaggucaaaga

SEQ ID NO: 3675 - RNA, 17 nt, Homo sapiens
aggucaaagacuaagug

SEQ ID NO: 3676 - RNA, 17 nt, Homo sapiens
auccaaauggaauucug

SEQ ID NO: 3677 - RNA, 17 nt, Homo sapiens
uccaaauggaauucugu

SEQ ID NO: 3678 - RNA, 17 nt, Homo sapiens
aauucugugauaaaggg

SEQ ID NO: 3679 - RNA, 17 nt, Homo sapiens
gugauaaagggaccuug

SEQ ID NO: 3680 - RNA, 17 nt, Homo sapiens
ugauaaagggaccuugg

SEQ ID NO: 3681 - RNA, 17 nt, Homo sapiens
gauaaagggaccuugga

SEQ ID NO: 3682 - RNA, 17 nt, Homo sapiens
gggaccuuggaacaaug

SEQ ID NO: 3683 - RNA, 17 nt, Homo sapiens
ggaccuuggaacaaugg

SEQ ID NO: 3684 - RNA, 17 nt, Homo sapiens
ggaacaauggauugaaa

SEQ ID NO: 3685 - RNA, 17 nt, Homo sapiens
gaacaauggauugaaaa

SEQ ID NO: 3686 - RNA, 17 nt, Homo sapiens
aauggauugaaaaaaga

SEQ ID NO: 3687 - RNA, 17 nt, Homo sapiens
ugaaaaaagaagaggcg

SEQ ID NO: 3688 - RNA, 17 nt, Homo sapiens
aaaaagaagaggcgaga

SEQ ID NO: 3689 - RNA, 17 nt, Homo sapiens
aaagaagaggcgagaaa

SEQ ID NO: 3690 - RNA, 17 nt, Homo sapiens
gaagaggcgagaaacua

SEQ ID NO: 3691 - RNA, 17 nt, Homo sapiens
agaggcgagaaacuaga

SEQ ID NO: 3692 - RNA, 17 nt, Homo sapiens
agaaacuagacaaaguu

SEQ ID NO: 3693 - RNA, 17 nt, Homo sapiens
aaaguuuuggcuuugga

SEQ ID NO: 3694 - RNA, 17 nt, Homo sapiens
uuggcuuuggaacucuu

SEQ ID NO: 3695 - RNA, 17 nt, Homo sapiens
uggcuuuggaacucuuu

SEQ ID NO: 3696 - RNA, 17 nt, Homo sapiens
aacucuuugaacaaaua

SEQ ID NO: 3697 - RNA, 17 nt, Homo sapiens
uaacaaaagggguggau

SEQ ID NO: 3698 - RNA, 17 nt, Homo sapiens
aacaaaagggguggauu

SEQ ID NO: 3699 - RNA, 17 nt, Homo sapiens
acaaaagggguggauua

SEQ ID NO: 3700 - RNA, 17 nt, Homo sapiens
aaagggguggauuauau

SEQ ID NO: 3701 - RNA, 17 nt, Homo sapiens
aagggguggauuauaua

SEQ ID NO: 3702 - RNA, 17 nt, Homo sapiens
aauucauagagaucuua

SEQ ID NO: 3703 - RNA, 17 nt, Homo sapiens
uucauagagaucuuaag

SEQ ID NO: 3704 - RNA, 17 nt, Homo sapiens
ucuuaguagauacaaaa

SEQ ID NO: 3705 - RNA, 17 nt, Homo sapiens
caaguaaagauuggaga

SEQ ID NO: 3706 - RNA, 17 nt, Homo sapiens
uaaagauuggagacuuu

SEQ ID NO: 3707 - RNA, 17 nt, Homo sapiens
aaagauuggagacuuug

SEQ ID NO: 3708 - RNA, 17 nt, Homo sapiens
agauuggagacuuugga

SEQ ID NO: 3709 - RNA, 17 nt, Homo sapiens
gagacuuuggacuugua

SEQ ID NO: 3710 - RNA, 17 nt, Homo sapiens
agacuuuggacuuguaa

SEQ ID NO: 3711 - RNA, 17 nt, Homo sapiens
acaucucugaaaaauga

SEQ ID NO: 3712 - RNA, 17 nt, Homo sapiens
ugaaaaaugauggaaag

SEQ ID NO: 3713 - RNA, 17 nt, Homo sapiens
aaaaugauggaaagcga

SEQ ID NO: 3714 - RNA, 17 nt, Homo sapiens
aaaugauggaaagcgaa

SEQ ID NO: 3715 - RNA, 17 nt, Homo sapiens
uggaaagcgaacaagga

SEQ ID NO: 3716 - RNA, 17 nt, Homo sapiens
gcgaacaaggaguaagg

SEQ ID NO: 3717 - RNA, 17 nt, Homo sapiens
cgaacaaggaguaaggg

SEQ ID NO: 3718 - RNA, 17 nt, Homo sapiens
aggaguaagggaacuuu

SEQ ID NO: 3719 - RNA, 17 nt, Homo sapiens
ggaguaagggaacuuug

SEQ ID NO: 3720 - RNA, 17 nt, Homo sapiens
gaguaagggaacuuugc

SEQ ID NO: 3721 - RNA, 17 nt, Homo sapiens
aacuuugcgauacauga

SEQ ID NO: 3722 - RNA, 17 nt, Homo sapiens
cgauacaugagcccaga

SEQ ID NO: 3723 - RNA, 17 nt, Homo sapiens
ugagcccagaacagauu

SEQ ID NO: 3724 - RNA, 17 nt, Homo sapiens
ccagaacagauuucuuc

SEQ ID NO: 3725 - RNA, 17 nt, Homo sapiens
cuucgcaagacuaugga

SEQ ID NO: 3726 - RNA, 17 nt, Homo sapiens
aagacuauggaaaggaa

SEQ ID NO: 3727 - RNA, 17 nt, Homo sapiens
agacuauggaaaggaag

SEQ ID NO: 3728 - RNA, 17 nt, Homo sapiens
uauggaaaggaagugga

SEQ ID NO: 3729 - RNA, 17 nt, Homo sapiens
auggaaaggaaguggac

SEQ ID NO: 3730 - RNA, 17 nt, Homo sapiens
aaggaaguggaccucua

SEQ ID NO: 3731 - RNA, 17 nt, Homo sapiens
aggaaguggaccucuac

SEQ ID NO: 3732 - RNA, 17 nt, Homo sapiens
uacgcuuuggggcuaau

SEQ ID NO: 3733 - RNA, 17 nt, Homo sapiens
acgcuuuggggcuaauu

SEQ ID NO: 3734 - RNA, 17 nt, Homo sapiens
cgcuuuggggcuaauuc

SEQ ID NO: 3735 - RNA, 17 nt, Homo sapiens
uucuugcugaacuucuu

SEQ ID NO: 3736 - RNA, 17 nt, Homo sapiens
auguaugugacacugcu

SEQ ID NO: 3737 - RNA, 17 nt, Homo sapiens
cugcuuuugaaacauca

SEQ ID NO: 3738 - RNA, 17 nt, Homo sapiens
uuuucacagaccuacgg

SEQ ID NO: 3739 - RNA, 17 nt, Homo sapiens
agaccuacgggauggca

SEQ ID NO: 3740 - RNA, 17 nt, Homo sapiens
gaccuacgggauggcau

SEQ ID NO: 3741 - RNA, 17 nt, Homo sapiens
accuacgggauggcauc

SEQ ID NO: 3742 - RNA, 17 nt, Homo sapiens
uacgggauggcaucauc

SEQ ID NO: 3743 - RNA, 17 nt, Homo sapiens
ucaucucagauauauuu

SEQ ID NO: 3744 - RNA, 17 nt, Homo sapiens
auauauuugauaaaaaa

SEQ ID NO: 3745 - RNA, 17 nt, Homo sapiens
auaaaaaagaaaaaacu

SEQ ID NO: 3746 - RNA, 17 nt, Homo sapiens
cuucuacagaaauuacu

SEQ ID NO: 3747 - RNA, 17 nt, Homo sapiens
cucucaaagaaaccuga

SEQ ID NO: 3748 - RNA, 17 nt, Homo sapiens
agaaaccugaggaucga

SEQ ID NO: 3749 - RNA, 17 nt, Homo sapiens
aaaccugaggaucgacc

SEQ ID NO: 3750 - RNA, 17 nt, Homo sapiens
aaccugaggaucgaccu

SEQ ID NO: 3751 - RNA, 17 nt, Homo sapiens
ugaggaucgaccuaaca

SEQ ID NO: 3752 - RNA, 17 nt, Homo sapiens
acacaucugaaauacua

SEQ ID NO: 3753 - RNA, 17 nt, Homo sapiens
aauacuaaggaccuuga

SEQ ID NO: 3754 - RNA, 17 nt, Homo sapiens
auacuaaggaccuugac

SEQ ID NO: 3755 - RNA, 17 nt, Homo sapiens
aggaccuugacugugug

SEQ ID NO: 3756 - RNA, 17 nt, Homo sapiens
gacuguguggaagaaaa

SEQ ID NO: 3757 - RNA, 17 nt, Homo sapiens
acuguguggaagaaaag

SEQ ID NO: 3758 - RNA, 17 nt, Homo sapiens
guguggaagaaaagccc

SEQ ID NO: 3759 - RNA, 17 nt, Homo sapiens
aaagcccagagaaaaau

SEQ ID NO: 3760 - RNA, 17 nt, Homo sapiens
agcccagagaaaaauga

SEQ ID NO: 3761 - RNA, 17 nt, Homo sapiens
agaaaaaugaacgacac

SEQ ID NO: 3762 - RNA, 17 nt, Homo sapiens
aaaugaacgacacacau

SEQ ID NO: 3763 - RNA, 17 nt, Homo sapiens
acauguuagagcccuuc

SEQ ID NO: 3764 - RNA, 17 nt, Homo sapiens
gcccuucugaaaaagua

SEQ ID NO: 3765 - RNA, 17 nt, Homo sapiens
cugcuucugauaugcag

SEQ ID NO: 3766 - RNA, 17 nt, Homo sapiens
aucugcuagggaauauc

SEQ ID NO: 3767 - RNA, 17 nt, Homo sapiens
ucugcuagggaauauca

SEQ ID NO: 3768 - RNA, 17 nt, Homo sapiens
cugcuagggaauaucaa

SEQ ID NO: 3769 - RNA, 17 nt, Homo sapiens
uaucaauagauauuuac

SEQ ID NO: 3770 - RNA, 17 nt, Homo sapiens
uuucugcagaaacagaa

SEQ ID NO: 3771 - RNA, 17 nt, Homo sapiens
cagaaacagaaagguuu

SEQ ID NO: 3772 - RNA, 17 nt, Homo sapiens
aacagaaagguuuucuu

SEQ ID NO: 3773 - RNA, 17 nt, Homo sapiens
uuuuuccuggcucaucu

SEQ ID NO: 3774 - RNA, 17 nt, Homo sapiens
uuuuuaaagacagaguc

SEQ ID NO: 3775 - RNA, 17 nt, Homo sapiens
uaaagacagagucucgc

SEQ ID NO: 3776 - RNA, 17 nt, Homo sapiens
guugcccaggcuggagu

SEQ ID NO: 3777 - RNA, 17 nt, Homo sapiens
cccaggcuggagugcaa

SEQ ID NO: 3778 - RNA, 17 nt, Homo sapiens
ccaggcuggagugcaau

SEQ ID NO: 3779 - RNA, 17 nt, Homo sapiens
agugcaaugacacaguc

SEQ ID NO: 3780 - RNA, 17 nt, Homo sapiens
acagucuuggcucacug

SEQ ID NO: 3781 - RNA, 17 nt, Homo sapiens
ugccucuuggguucaag

SEQ ID NO: 3782 - RNA, 17 nt, Homo sapiens
gccucuuggguucaagu

SEQ ID NO: 3783 - RNA, 17 nt, Homo sapiens
guucaagugauucuccu

SEQ ID NO: 3784 - RNA, 17 nt, Homo sapiens
agccuccugaguagcug

SEQ ID NO: 3785 - RNA, 17 nt, Homo sapiens
gaguagcuggauuacag

SEQ ID NO: 3786 - RNA, 17 nt, Homo sapiens
aguagcuggauuacagg

SEQ ID NO: 3787 - RNA, 17 nt, Homo sapiens
ggauuacaggcaugugc

SEQ ID NO: 3788 - RNA, 17 nt, Homo sapiens
uuaauaaagacaggguu

SEQ ID NO: 3789 - RNA, 17 nt, Homo sapiens
uaaagacaggguuucac

SEQ ID NO: 3790 - RNA, 17 nt, Homo sapiens
aaagacaggguuucacc

SEQ ID NO: 3791 - RNA, 17 nt, Homo sapiens
accauguuggccaggcu

SEQ ID NO: 3792 - RNA, 17 nt, Homo sapiens
guuggccaggcuggucu

SEQ ID NO: 3793 - RNA, 17 nt, Homo sapiens
gccaggcuggucucaaa

SEQ ID NO: 3794 - RNA, 17 nt, Homo sapiens
aaacuccugaccucaag

SEQ ID NO: 3795 - RNA, 17 nt, Homo sapiens
ccugccucggccuccca

SEQ ID NO: 3796 - RNA, 17 nt, Homo sapiens
aaagugcugggauuaca

SEQ ID NO: 3797 - RNA, 17 nt, Homo sapiens
aagugcugggauuacag

SEQ ID NO: 3798 - RNA, 17 nt, Homo sapiens
agugcugggauuacagg

SEQ ID NO: 3799 - RNA, 17 nt, Homo sapiens
ggauuacagggaugagc

SEQ ID NO: 3800 - RNA, 17 nt, Homo sapiens
gauuacagggaugagcc

SEQ ID NO: 3801 - RNA, 17 nt, Homo sapiens
auuacagggaugagcca

SEQ ID NO: 3802 - RNA, 17 nt, Homo sapiens
acagggaugagccaccg

SEQ ID NO: 3803 - RNA, 17 nt, Homo sapiens
guucuaaagauggaaaa

SEQ ID NO: 3804 - RNA, 17 nt, Homo sapiens
cuaaagauggaaaaacc

SEQ ID NO: 3805 - RNA, 17 nt, Homo sapiens
uaaagauggaaaaacca

SEQ ID NO: 3806 - RNA, 17 nt, Homo sapiens
cuauuaaugaaucaauc

SEQ ID NO: 3807 - RNA, 17 nt, Homo sapiens
cgcuuuuaggccaaaaa

SEQ ID NO: 3808 - RNA, 17 nt, Homo sapiens
aaauguaagaucguucu

SEQ ID NO: 3809 - RNA, 17 nt, Homo sapiens
agccagcuggagaaaua

SEQ ID NO: 3810 - RNA, 17 nt, Homo sapiens
gccagcuggagaaauau

SEQ ID NO: 3811 - RNA, 17 nt, Homo sapiens
cagcuggagaaauaugg

SEQ ID NO: 3812 - RNA, 17 nt, Homo sapiens
agaaauaugguacucau

SEQ ID NO: 3813 - RNA, 17 nt, Homo sapiens
aaaaaagugauguacaa

SEQ ID NO: 3814 - RNA, 48 nt, Artificial Sequence
  Description of Artificial Sequence:  Enzymatic Nucleic Acid
ugcgccgcggaggaaacucccuucaaggacaucguccggggccgccgc

SEQ ID NO: 3815 - RNA, 48 nt, Artificial Sequence
  Description of Artificial Sequence:  Enzymatic Nucleic Acid
cugcgccgggaggaaacucccuucaaggacaucguccgggcgccgccg

SEQ ID NO: 3816 - RNA, 48 nt, Artificial Sequence
  Description of Artificial Sequence:  Enzymatic Nucleic Acid
aacugcgcggaggaaacucccuucaaggacaucguccggggccgccgc

SEQ ID NO: 3817 - RNA, 48 nt, Artificial Sequence
  Description of Artificial Sequence:  Enzymatic Nucleic Acid
aaacugcgggaggaaacucccuucaaggacaucguccgggcgccgccg

SEQ ID NO: 3818 - RNA, 48 nt, Artificial Sequence
  Description of Artificial Sequence:  Enzymatic Nucleic Acid
gcaaacugggaggaaacucccuucaaggacaucguccggggccgccgc

SEQ ID NO: 3819 - RNA, 48 nt, Artificial Sequence
  Description of Artificial Sequence:  Enzymatic Nucleic Acid
ugagcaaaggaggaaacucccuucaaggacaucguccgggugcgccgc

SEQ ID NO: 3820 - RNA, 48 nt, Artificial Sequence
  Description of Artificial Sequence:  Enzymatic Nucleic Acid
aguaugagggaggaaacucccuucaaggacaucguccgggaaacugcg

SEQ ID NO: 3821 - RNA, 48 nt, Artificial Sequence
  Description of Artificial Sequence:  Enzymatic Nucleic Acid
gcaagucaggaggaaacucccuucaaggacaucguccgggaaaguaug

SEQ ID NO: 3822 - RNA, 48 nt, Artificial Sequence
  Description of Artificial Sequence:  Enzymatic Nucleic Acid
ccgcaaguggaggaaacucccuucaaggacaucguccgggacaaagua

SEQ ID NO: 3823 - RNA, 48 nt, Artificial Sequence
  Description of Artificial Sequence:  Enzymatic Nucleic Acid
ugugaccgggaggaaacucccuucaaggacaucguccgggaagucaca

SEQ ID NO: 3824 - RNA, 48 nt, Artificial Sequence
  Description of Artificial Sequence:  Enzymatic Nucleic Acid
acugugacggaggaaacucccuucaaggacaucguccggggcaaguca

SEQ ID NO: 3825 - RNA, 48 nt, Artificial Sequence
  Description of Artificial Sequence:  Enzymatic Nucleic Acid
cacugugaggaggaaacucccuucaaggacaucguccgggcgcaaguc

SEQ ID NO: 3826 - RNA, 48 nt, Artificial Sequence
  Description of Artificial Sequence:  Enzymatic Nucleic Acid
gaaugccaggaggaaacucccuucaaggacaucguccgggugugaccg

SEQ ID NO: 3827 - RNA, 48 nt, Artificial Sequence
  Description of Artificial Sequence:  Enzymatic Nucleic Acid
cugaaugcggaggaaacucccuucaaggacaucguccgggacugugac

SEQ ID NO: 3828 - RNA, 48 nt, Artificial Sequence
  Description of Artificial Sequence:  Enzymatic Nucleic Acid
gcugaaugggaggaaacucccuucaaggacaucguccgggcacuguga

SEQ ID NO: 3829 - RNA, 48 nt, Artificial Sequence
  Description of Artificial Sequence:  Enzymatic Nucleic Acid
guguggagggaggaaacucccuucaaggacaucguccgggugaaugcc

SEQ ID NO: 3830 - RNA, 48 nt, Artificial Sequence
  Description of Artificial Sequence:  Enzymatic Nucleic Acid
gguucuacggaggaaacucccuucaaggacaucguccgggaagugugg

SEQ ID NO: 3831 - RNA, 48 nt, Artificial Sequence
  Description of Artificial Sequence:  Enzymatic Nucleic Acid
ugguucuaggaggaaacucccuucaaggacaucguccgggcaagugug

SEQ ID NO: 3832 - RNA, 48 nt, Artificial Sequence
  Description of Artificial Sequence:  Enzymatic Nucleic Acid
cugugguuggaggaaacucccuucaaggacaucguccggguaccaagu

SEQ ID NO: 3833 - RNA, 48 nt, Artificial Sequence
  Description of Artificial Sequence:  Enzymatic Nucleic Acid
ugucgugcggaggaaacucccuucaaggacaucguccgggugugguuc

SEQ ID NO: 3834 - RNA, 48 nt, Artificial Sequence
  Description of Artificial Sequence:  Enzymatic Nucleic Acid
uugucgugggaggaaacucccuucaaggacaucguccgggcugugguu

SEQ ID NO: 3835 - RNA, 48 nt, Artificial Sequence
  Description of Artificial Sequence:  Enzymatic Nucleic Acid
augcuuguggaggaaacucccuucaaggacaucguccggggugccugu

SEQ ID NO: 3836 - RNA, 48 nt, Artificial Sequence
  Description of Artificial Sequence:  Enzymatic Nucleic Acid
uuucuaugggaggaaacucccuucaaggacaucguccggguugucgug

SEQ ID NO: 3837 - RNA, 48 nt, Artificial Sequence
  Description of Artificial Sequence:  Enzymatic Nucleic Acid
ggauguuuggaggaaacucccuucaaggacaucguccggguaugcuug

SEQ ID NO: 3838 - RNA, 48 nt, Artificial Sequence
  Description of Artificial Sequence:  Enzymatic Nucleic Acid
cgaugccuggaggaaacucccuucaaggacaucguccggggaugaaga

SEQ ID NO: 3839 - RNA, 48 nt, Artificial Sequence
  Description of Artificial Sequence:  Enzymatic Nucleic Acid
cucgaugcggaggaaacucccuucaaggacaucguccgggucgaugaa

SEQ ID NO: 3840 - RNA, 48 nt, Artificial Sequence
  Description of Artificial Sequence:  Enzymatic Nucleic Acid
ccucgaugggaggaaacucccuucaaggacaucguccgggcucgauga

SEQ ID NO: 3841 - RNA, 48 nt, Artificial Sequence
  Description of Artificial Sequence:  Enzymatic Nucleic Acid
auggaccuggaggaaacucccuucaaggacaucguccggggaugccuc

SEQ ID NO: 3842 - RNA, 48 nt, Artificial Sequence
  Description of Artificial Sequence:  Enzymatic Nucleic Acid
ggauggacggaggaaacucccuucaaggacaucguccgggucgaugcc

SEQ ID NO: 3843 - RNA, 48 nt, Artificial Sequence
  Description of Artificial Sequence:  Enzymatic Nucleic Acid
gggauggaggaggaaacucccuucaaggacaucguccgggcucgaugc

SEQ ID NO: 3844 - RNA, 48 nt, Artificial Sequence
  Description of Artificial Sequence:  Enzymatic Nucleic Acid
agggucucggaggaaacucccuucaaggacaucguccgggugauuuuu

SEQ ID NO: 3845 - RNA, 48 nt, Artificial Sequence
  Description of Artificial Sequence:  Enzymatic Nucleic Acid
cagggucuggaggaaacucccuucaaggacaucguccgggcugauuuu

SEQ ID NO: 3846 - RNA, 48 nt, Artificial Sequence
  Description of Artificial Sequence:  Enzymatic Nucleic Acid
gccaggguggaggaaacucccuucaaggacaucguccggguccugauu

SEQ ID NO: 3847 - RNA, 48 nt, Artificial Sequence
  Description of Artificial Sequence:  Enzymatic Nucleic Acid
augauagcggaggaaacucccuucaaggacaucguccgggagggucuc

SEQ ID NO: 3848 - RNA, 48 nt, Artificial Sequence
  Description of Artificial Sequence:  Enzymatic Nucleic Acid
uaugauagggaggaaacucccuucaaggacaucguccgggcagggucu

SEQ ID NO: 3849 - RNA, 48 nt, Artificial Sequence
  Description of Artificial Sequence:  Enzymatic Nucleic Acid
acuaagguggaggaaacucccuucaaggacaucguccggguaugauag

SEQ ID NO: 3850 - RNA, 48 nt, Artificial Sequence
  Description of Artificial Sequence:  Enzymatic Nucleic Acid
agcgaagaggaggaaacucccuucaaggacaucguccggguaaggucu

SEQ ID NO: 3851 - RNA, 48 nt, Artificial Sequence
  Description of Artificial Sequence:  Enzymatic Nucleic Acid
uauaccagggaggaaacucccuucaaggacaucguccggggaagacua

SEQ ID NO: 3852 - RNA, 48 nt, Artificial Sequence
  Description of Artificial Sequence:  Enzymatic Nucleic Acid
gaguauacggaggaaacucccuucaaggacaucguccgggagcgaaga

SEQ ID NO: 3853 - RNA, 48 nt, Artificial Sequence
  Description of Artificial Sequence:  Enzymatic Nucleic Acid
cgaguauaggaggaaacucccuucaaggacaucguccgggcagcgaag

SEQ ID NO: 3854 - RNA, 48 nt, Artificial Sequence
  Description of Artificial Sequence:  Enzymatic Nucleic Acid
acagacagggaggaaacucccuucaaggacaucguccggggaguauac

SEQ ID NO: 3855 - RNA, 48 nt, Artificial Sequence
  Description of Artificial Sequence:  Enzymatic Nucleic Acid
uugacagaggaggaaacucccuucaaggacaucguccgggagcgagua

SEQ ID NO: 3856 - RNA, 48 nt, Artificial Sequence
  Description of Artificial Sequence:  Enzymatic Nucleic Acid
cugguugaggaggaaacucccuucaaggacaucguccgggagacagcg

SEQ ID NO: 3857 - RNA, 48 nt, Artificial Sequence
  Description of Artificial Sequence:  Enzymatic Nucleic Acid
gucaaccgggaggaaacucccuucaaggacaucguccgggugguugac

SEQ ID NO: 3858 - RNA, 48 nt, Artificial Sequence
  Description of Artificial Sequence:  Enzymatic Nucleic Acid
aagucaacggaggaaacucccuucaaggacaucguccggggcugguug

SEQ ID NO: 3859 - RNA, 48 nt, Artificial Sequence
  Description of Artificial Sequence:  Enzymatic Nucleic Acid
aaagucaaggaggaaacucccuucaaggacaucguccgggcgcugguu

SEQ ID NO: 3860 - RNA, 48 nt, Artificial Sequence
  Description of Artificial Sequence:  Enzymatic Nucleic Acid
aaaaaaguggaggaaacucccuucaaggacaucguccgggaaccgcug

SEQ ID NO: 3861 - RNA, 48 nt, Artificial Sequence
  Description of Artificial Sequence:  Enzymatic Nucleic Acid
aaagaaggggaggaaacucccuucaaggacaucguccggguuaaaaaa

SEQ ID NO: 3862 - RNA, 48 nt, Artificial Sequence
  Description of Artificial Sequence:  Enzymatic Nucleic Acid
uccagaaaggaggaaacucccuucaaggacaucguccgggugguaaaa

SEQ ID NO: 3863 - RNA, 48 nt, Artificial Sequence
  Description of Artificial Sequence:  Enzymatic Nucleic Acid
auuugcucggaggaaacucccuucaaggacaucguccgggagaaacug

SEQ ID NO: 3864 - RNA, 48 nt, Artificial Sequence
  Description of Artificial Sequence:  Enzymatic Nucleic Acid
aauuugcuggaggaaacucccuucaaggacaucguccgggcagaaacu

SEQ ID NO: 3865 - RNA, 48 nt, Artificial Sequence
  Description of Artificial Sequence:  Enzymatic Nucleic Acid
ugaauuugggaggaaacucccuucaaggacaucguccggguccagaaa

SEQ ID NO: 3866 - RNA, 48 nt, Artificial Sequence
  Description of Artificial Sequence:  Enzymatic Nucleic Acid
aaggcaaaggaggaaacucccuucaaggacaucguccgggugaauuug

SEQ ID NO: 3867 - RNA, 48 nt, Artificial Sequence
  Description of Artificial Sequence:  Enzymatic Nucleic Acid
caggaaggggaggaaacucccuucaaggacaucguccgggaaacugaa

SEQ ID NO: 3868 - RNA, 48 nt, Artificial Sequence
  Description of Artificial Sequence:  Enzymatic Nucleic Acid
uacaaaucggaggaaacucccuucaaggacaucguccgggaggaaggc

SEQ ID NO: 3869 - RNA, 48 nt, Artificial Sequence
  Description of Artificial Sequence:  Enzymatic Nucleic Acid
uuacaaauggaggaaacucccuucaaggacaucguccgggcaggaagg

SEQ ID NO: 3870 - RNA, 48 nt, Artificial Sequence
  Description of Artificial Sequence:  Enzymatic Nucleic Acid
acaauuuaggaggaaacucccuucaaggacaucguccgggaaauccag

SEQ ID NO: 3871 - RNA, 48 nt, Artificial Sequence
  Description of Artificial Sequence:  Enzymatic Nucleic Acid
ggucauuaggaggaaacucccuucaaggacaucguccgggaauuuaca

SEQ ID NO: 3872 - RNA, 48 nt, Artificial Sequence
  Description of Artificial Sequence:  Enzymatic Nucleic Acid
uuugagguggaggaaacucccuucaaggacaucguccgggauuacaau

SEQ ID NO: 3873 - RNA, 48 nt, Artificial Sequence
  Description of Artificial Sequence:  Enzymatic Nucleic Acid
aagaacugggaggaaacucccuucaaggacaucguccggguaaaguuu

SEQ ID NO: 3874 - RNA, 48 nt, Artificial Sequence
  Description of Artificial Sequence:  Enzymatic Nucleic Acid
uggaagaaggaggaaacucccuucaaggacaucguccgggugcuaaag

SEQ ID NO: 3875 - RNA, 48 nt, Artificial Sequence
  Description of Artificial Sequence:  Enzymatic Nucleic Acid
accugaguggaggaaacucccuucaaggacaucguccgggagauggaa

SEQ ID NO: 3876 - RNA, 48 nt, Artificial Sequence
  Description of Artificial Sequence:  Enzymatic Nucleic Acid
aagcaaacggaggaaacucccuucaaggacaucguccgggugagucag

SEQ ID NO: 3877 - RNA, 48 nt, Artificial Sequence
  Description of Artificial Sequence:  Enzymatic Nucleic Acid
gaagcaaaggaggaaacucccuucaaggacaucguccgggcugaguca

SEQ ID NO: 3878 - RNA, 48 nt, Artificial Sequence
  Description of Artificial Sequence:  Enzymatic Nucleic Acid
cagagaagggaggaaacucccuucaaggacaucguccgggaaaccuga

SEQ ID NO: 3879 - RNA, 48 nt, Artificial Sequence
  Description of Artificial Sequence:  Enzymatic Nucleic Acid
aagaccgcggaggaaacucccuucaaggacaucguccgggagagaagc

SEQ ID NO: 3880 - RNA, 48 nt, Artificial Sequence
  Description of Artificial Sequence:  Enzymatic Nucleic Acid
gaagaccgggaggaaacucccuucaaggacaucguccgggcagagaag

SEQ ID NO: 3881 - RNA, 48 nt, Artificial Sequence
  Description of Artificial Sequence:  Enzymatic Nucleic Acid
cugaagacggaggaaacucccuucaaggacaucguccggggccagaga

SEQ ID NO: 3882 - RNA, 48 nt, Artificial Sequence
  Description of Artificial Sequence:  Enzymatic Nucleic Acid
ucugaagaggaggaaacucccuucaaggacaucguccgggcgccagag

SEQ ID NO: 3883 - RNA, 48 nt, Artificial Sequence
  Description of Artificial Sequence:  Enzymatic Nucleic Acid
uguugauuggaggaaacucccuucaaggacaucguccgggugaagacc

SEQ ID NO: 3884 - RNA, 48 nt, Artificial Sequence
  Description of Artificial Sequence:  Enzymatic Nucleic Acid
gauaaucaggaggaaacucccuucaaggacaucguccgggggaagugu

SEQ ID NO: 3885 - RNA, 48 nt, Artificial Sequence
  Description of Artificial Sequence:  Enzymatic Nucleic Acid
cagauaauggaggaaacucccuucaaggacaucguccgggacggaagu

SEQ ID NO: 3886 - RNA, 48 nt, Artificial Sequence
  Description of Artificial Sequence:  Enzymatic Nucleic Acid
aaugcacgggaggaaacucccuucaaggacaucguccgggagauaauc

SEQ ID NO: 3887 - RNA, 48 nt, Artificial Sequence
  Description of Artificial Sequence:  Enzymatic Nucleic Acid
aaaaugcaggaggaaacucccuucaaggacaucguccggggcagauaa

SEQ ID NO: 3888 - RNA, 48 nt, Artificial Sequence
  Description of Artificial Sequence:  Enzymatic Nucleic Acid
ccaaaaugggaggaaacucccuucaaggacaucguccgggacgcagau

SEQ ID NO: 3889 - RNA, 48 nt, Artificial Sequence
  Description of Artificial Sequence:  Enzymatic Nucleic Acid
gcuuugucggaggaaacucccuucaaggacaucguccgggaaaaugca

SEQ ID NO: 3890 - RNA, 48 nt, Artificial Sequence
  Description of Artificial Sequence:  Enzymatic Nucleic Acid
agcuuuguggaggaaacucccuucaaggacaucguccgggcaaaaugc

SEQ ID NO: 3891 - RNA, 48 nt, Artificial Sequence
  Description of Artificial Sequence:  Enzymatic Nucleic Acid
guuggaagggaggaaacucccuucaaggacaucguccggguuugucca

SEQ ID NO: 3892 - RNA, 48 nt, Artificial Sequence
  Description of Artificial Sequence:  Enzymatic Nucleic Acid
cccguaucggaggaaacucccuucaaggacaucguccgggugguugga

SEQ ID NO: 3893 - RNA, 48 nt, Artificial Sequence
  Description of Artificial Sequence:  Enzymatic Nucleic Acid
ucccguauggaggaaacucccuucaaggacaucguccgggcugguugg

SEQ ID NO: 3894 - RNA, 48 nt, Artificial Sequence
  Description of Artificial Sequence:  Enzymatic Nucleic Acid
cuucuuccggaggaaacucccuucaaggacaucguccgggguauccug

SEQ ID NO: 3895 - RNA, 48 nt, Artificial Sequence
  Description of Artificial Sequence:  Enzymatic Nucleic Acid
ucuucuucggaggaaacucccuucaaggacaucguccgggcguauccu

SEQ ID NO: 3896 - RNA, 48 nt, Artificial Sequence
  Description of Artificial Sequence:  Enzymatic Nucleic Acid
uucuucuuggaggaaacucccuucaaggacaucguccgggccguaucc

SEQ ID NO: 3897 - RNA, 48 nt, Artificial Sequence
  Description of Artificial Sequence:  Enzymatic Nucleic Acid
cauuucuuggaggaaacucccuucaaggacaucguccggguucccgua

SEQ ID NO: 3898 - RNA, 48 nt, Artificial Sequence
  Description of Artificial Sequence:  Enzymatic Nucleic Acid
agccauuuggaggaaacucccuucaaggacaucguccggguucuuccc

SEQ ID NO: 3899 - RNA, 48 nt, Artificial Sequence
  Description of Artificial Sequence:  Enzymatic Nucleic Acid
ucaccagcggaggaaacucccuucaaggacaucguccgggauuucuuc

SEQ ID NO: 3900 - RNA, 48 nt, Artificial Sequence
  Description of Artificial Sequence:  Enzymatic Nucleic Acid
aucaccagggaggaaacucccuucaaggacaucguccgggcauuucuu

SEQ ID NO: 3901 - RNA, 48 nt, Artificial Sequence
  Description of Artificial Sequence:  Enzymatic Nucleic Acid
aagaucacggaggaaacucccuucaaggacaucguccgggagccauuu

SEQ ID NO: 3902 - RNA, 48 nt, Artificial Sequence
  Description of Artificial Sequence:  Enzymatic Nucleic Acid
aaagaucaggaggaaacucccuucaaggacaucguccgggcagccauu

SEQ ID NO: 3903 - RNA, 48 nt, Artificial Sequence
  Description of Artificial Sequence:  Enzymatic Nucleic Acid
ugaaagauggaggaaacucccuucaaggacaucguccgggaccagcca

SEQ ID NO: 3904 - RNA, 48 nt, Artificial Sequence
  Description of Artificial Sequence:  Enzymatic Nucleic Acid
gaaaccugggaggaaacucccuucaaggacaucguccgggugaaagau

SEQ ID NO: 3905 - RNA, 48 nt, Artificial Sequence
  Description of Artificial Sequence:  Enzymatic Nucleic Acid
gaagaaacggaggaaacucccuucaaggacaucguccgggugcugaaa

SEQ ID NO: 3906 - RNA, 48 nt, Artificial Sequence
  Description of Artificial Sequence:  Enzymatic Nucleic Acid
ugaagaaaggaggaaacucccuucaaggacaucguccgggcugcugaa

SEQ ID NO: 3907 - RNA, 48 nt, Artificial Sequence
  Description of Artificial Sequence:  Enzymatic Nucleic Acid
aguuccucggaggaaacucccuucaaggacaucguccgggaugaagaa

SEQ ID NO: 3908 - RNA, 48 nt, Artificial Sequence
  Description of Artificial Sequence:  Enzymatic Nucleic Acid
aaguuccuggaggaaacucccuucaaggacaucguccgggcaugaaga

SEQ ID NO: 3909 - RNA, 48 nt, Artificial Sequence
  Description of Artificial Sequence:  Enzymatic Nucleic Acid
uuaaguucggaggaaacucccuucaaggacaucguccggguccaugaa

SEQ ID NO: 3910 - RNA, 48 nt, Artificial Sequence
  Description of Artificial Sequence:  Enzymatic Nucleic Acid
auuaaguuggaggaaacucccuucaaggacaucguccgggcuccauga

SEQ ID NO: 3911 - RNA, 48 nt, Artificial Sequence
  Description of Artificial Sequence:  Enzymatic Nucleic Acid
gcuucugaggaggaaacucccuucaaggacaucguccggggguaugua

SEQ ID NO: 3912 - RNA, 48 nt, Artificial Sequence
  Description of Artificial Sequence:  Enzymatic Nucleic Acid
cccugcuuggaggaaacucccuucaaggacaucguccgggugacggua

SEQ ID NO: 3913 - RNA, 48 nt, Artificial Sequence
  Description of Artificial Sequence:  Enzymatic Nucleic Acid
acucccugggaggaaacucccuucaaggacaucguccggguucugacg

SEQ ID NO: 3914 - RNA, 48 nt, Artificial Sequence
  Description of Artificial Sequence:  Enzymatic Nucleic Acid
acuacuccggaggaaacucccuucaaggacaucguccgggugcuucug

SEQ ID NO: 3915 - RNA, 48 nt, Artificial Sequence
  Description of Artificial Sequence:  Enzymatic Nucleic Acid
uacuacucggaggaaacucccuucaaggacaucguccgggcugcuucu

SEQ ID NO: 3916 - RNA, 48 nt, Artificial Sequence
  Description of Artificial Sequence:  Enzymatic Nucleic Acid
guacuacuggaggaaacucccuucaaggacaucguccgggccugcuuc

SEQ ID NO: 3917 - RNA, 48 nt, Artificial Sequence
  Description of Artificial Sequence:  Enzymatic Nucleic Acid
aaguacuaggaggaaacucccuucaaggacaucguccgggucccugcu

SEQ ID NO: 3918 - RNA, 48 nt, Artificial Sequence
  Description of Artificial Sequence:  Enzymatic Nucleic Acid
uuuaaguaggaggaaacucccuucaaggacaucguccggguacucccu

SEQ ID NO: 3919 - RNA, 48 nt, Artificial Sequence
  Description of Artificial Sequence:  Enzymatic Nucleic Acid
aggcaguuggaggaaacucccuucaaggacaucguccggguugauauu

SEQ ID NO: 3920 - RNA, 48 nt, Artificial Sequence
  Description of Artificial Sequence:  Enzymatic Nucleic Acid
gaauuaggggaggaaacucccuucaaggacaucguccgggaguucuug

SEQ ID NO: 3921 - RNA, 48 nt, Artificial Sequence
  Description of Artificial Sequence:  Enzymatic Nucleic Acid
uggaggucggaggaaacucccuucaaggacaucguccgggugaauuag

SEQ ID NO: 3922 - RNA, 48 nt, Artificial Sequence
  Description of Artificial Sequence:  Enzymatic Nucleic Acid
guggagguggaggaaacucccuucaaggacaucguccgggcugaauua

SEQ ID NO: 3923 - RNA, 48 nt, Artificial Sequence
  Description of Artificial Sequence:  Enzymatic Nucleic Acid
ccuccuauggaggaaacucccuucaaggacaucguccgggauguggag

SEQ ID NO: 3924 - RNA, 48 nt, Artificial Sequence
  Description of Artificial Sequence:  Enzymatic Nucleic Acid
uaaaccucggaggaaacucccuucaaggacaucguccggguaucaugu

SEQ ID NO: 3925 - RNA, 48 nt, Artificial Sequence
  Description of Artificial Sequence:  Enzymatic Nucleic Acid
guaaaccuggaggaaacucccuucaaggacaucguccgggcuaucaug

SEQ ID NO: 3926 - RNA, 48 nt, Artificial Sequence
  Description of Artificial Sequence:  Enzymatic Nucleic Acid
auguaaacggaggaaacucccuucaaggacaucguccggguccuauca

SEQ ID NO: 3927 - RNA, 48 nt, Artificial Sequence
  Description of Artificial Sequence:  Enzymatic Nucleic Acid
aauguaaaggaggaaacucccuucaaggacaucguccgggcuccuauc

SEQ ID NO: 3928 - RNA, 48 nt, Artificial Sequence
  Description of Artificial Sequence:  Enzymatic Nucleic Acid
uauuauaaggaggaaacucccuucaaggacaucguccggguugaaaug

SEQ ID NO: 3929 - RNA, 48 nt, Artificial Sequence
  Description of Artificial Sequence:  Enzymatic Nucleic Acid
ucuuccauggaggaaacucccuucaaggacaucguccggguauuauaa

SEQ ID NO: 3930 - RNA, 48 nt, Artificial Sequence
  Description of Artificial Sequence:  Enzymatic Nucleic Acid
uucucuucggaggaaacucccuucaaggacaucguccgggaucuauua

SEQ ID NO: 3931 - RNA, 48 nt, Artificial Sequence
  Description of Artificial Sequence:  Enzymatic Nucleic Acid
auucucuuggaggaaacucccuucaaggacaucguccgggcaucuauu

SEQ ID NO: 3932 - RNA, 48 nt, Artificial Sequence
  Description of Artificial Sequence:  Enzymatic Nucleic Acid
gaaauucuggaggaaacucccuucaaggacaucguccggguuccaucu

SEQ ID NO: 3933 - RNA, 48 nt, Artificial Sequence
  Description of Artificial Sequence:  Enzymatic Nucleic Acid
uggaaauuggaggaaacucccuucaaggacaucguccgggucuuccau

SEQ ID NO: 3934 - RNA, 48 nt, Artificial Sequence
  Description of Artificial Sequence:  Enzymatic Nucleic Acid
uucaccuuggaggaaacucccuucaaggacaucguccggguggaaauu

SEQ ID NO: 3935 - RNA, 48 nt, Artificial Sequence
  Description of Artificial Sequence:  Enzymatic Nucleic Acid
accuucacggaggaaacucccuucaaggacaucguccggguucuggaa

SEQ ID NO: 3936 - RNA, 48 nt, Artificial Sequence
  Description of Artificial Sequence:  Enzymatic Nucleic Acid
uaccuucaggaggaaacucccuucaaggacaucguccgggcuucugga

SEQ ID NO: 3937 - RNA, 48 nt, Artificial Sequence
  Description of Artificial Sequence:  Enzymatic Nucleic Acid
ucuaccuuggaggaaacucccuucaaggacaucguccgggaccuucug

SEQ ID NO: 3938 - RNA, 48 nt, Artificial Sequence
  Description of Artificial Sequence:  Enzymatic Nucleic Acid
ugaucuacggaggaaacucccuucaaggacaucguccggguucaccuu

SEQ ID NO: 3939 - RNA, 48 nt, Artificial Sequence
  Description of Artificial Sequence:  Enzymatic Nucleic Acid
uugaucuaggaggaaacucccuucaaggacaucguccgggcuucaccu

SEQ ID NO: 3940 - RNA, 48 nt, Artificial Sequence
  Description of Artificial Sequence:  Enzymatic Nucleic Acid
ucuuugauggaggaaacucccuucaaggacaucguccggguaccuuca

SEQ ID NO: 3941 - RNA, 48 nt, Artificial Sequence
  Description of Artificial Sequence:  Enzymatic Nucleic Acid
gcuuccuuggaggaaacucccuucaaggacaucguccggguuugaucu

SEQ ID NO: 3942 - RNA, 48 nt, Artificial Sequence
  Description of Artificial Sequence:  Enzymatic Nucleic Acid
uuugcuucggaggaaacucccuucaaggacaucguccggguucuuuga

SEQ ID NO: 3943 - RNA, 48 nt, Artificial Sequence
  Description of Artificial Sequence:  Enzymatic Nucleic Acid
uuuugcuuggaggaaacucccuucaaggacaucguccgggcuucuuug

SEQ ID NO: 3944 - RNA, 48 nt, Artificial Sequence
  Description of Artificial Sequence:  Enzymatic Nucleic Acid
auuuuuugggaggaaacucccuucaaggacaucguccggguuccuucu

SEQ ID NO: 3945 - RNA, 48 nt, Artificial Sequence
  Description of Artificial Sequence:  Enzymatic Nucleic Acid
ggcugcggggaggaaacucccuucaaggacaucguccgggauuuuuug

SEQ ID NO: 3946 - RNA, 48 nt, Artificial Sequence
  Description of Artificial Sequence:  Enzymatic Nucleic Acid
uuuggcugggaggaaacucccuucaaggacaucguccgggggcauuuu

SEQ ID NO: 3947 - RNA, 48 nt, Artificial Sequence
  Description of Artificial Sequence:  Enzymatic Nucleic Acid
uaauuuggggaggaaacucccuucaaggacaucguccgggugcggcau

SEQ ID NO: 3948 - RNA, 48 nt, Artificial Sequence
  Description of Artificial Sequence:  Enzymatic Nucleic Acid
cucaacagggaggaaacucccuucaaggacaucguccggguaauuugg

SEQ ID NO: 3949 - RNA, 48 nt, Artificial Sequence
  Description of Artificial Sequence:  Enzymatic Nucleic Acid
uaucucaaggaggaaacucccuucaaggacaucguccgggagcuaauu

SEQ ID NO: 3950 - RNA, 48 nt, Artificial Sequence
  Description of Artificial Sequence:  Enzymatic Nucleic Acid
aaguaucuggaggaaacucccuucaaggacaucguccgggaacagcua

SEQ ID NO: 3951 - RNA, 48 nt, Artificial Sequence
  Description of Artificial Sequence:  Enzymatic Nucleic Acid
uuaaguauggaggaaacucccuucaaggacaucguccgggucaacagc

SEQ ID NO: 3952 - RNA, 48 nt, Artificial Sequence
  Description of Artificial Sequence:  Enzymatic Nucleic Acid
uucuuuucggaggaaacucccuucaaggacaucguccggguuauuaag

SEQ ID NO: 3953 - RNA, 48 nt, Artificial Sequence
  Description of Artificial Sequence:  Enzymatic Nucleic Acid
cuucuuuuggaggaaacucccuucaaggacaucguccgggcuuauuaa

SEQ ID NO: 3954 - RNA, 48 nt, Artificial Sequence
  Description of Artificial Sequence:  Enzymatic Nucleic Acid
acugccuuggaggaaacucccuucaaggacaucguccggguuuuccuu

SEQ ID NO: 3955 - RNA, 48 nt, Artificial Sequence
  Description of Artificial Sequence:  Enzymatic Nucleic Acid
cuaacugcggaggaaacucccuucaaggacaucguccggguucuuuuc

SEQ ID NO: 3956 - RNA, 48 nt, Artificial Sequence
  Description of Artificial Sequence:  Enzymatic Nucleic Acid
acuaacugggaggaaacucccuucaaggacaucguccgggcuucuuuu

SEQ ID NO: 3957 - RNA, 48 nt, Artificial Sequence
  Description of Artificial Sequence:  Enzymatic Nucleic Acid
aggacuaaggaggaaacucccuucaaggacaucguccgggugccuucu

SEQ ID NO: 3958 - RNA, 48 nt, Artificial Sequence
  Description of Artificial Sequence:  Enzymatic Nucleic Acid
auaaaggaggaggaaacucccuucaaggacaucguccggguaacugcc

SEQ ID NO: 3959 - RNA, 48 nt, Artificial Sequence
  Description of Artificial Sequence:  Enzymatic Nucleic Acid
guuguuguggaggaaacucccuucaaggacaucguccgggaauaauaa

SEQ ID NO: 3960 - RNA, 48 nt, Artificial Sequence
  Description of Artificial Sequence:  Enzymatic Nucleic Acid
gaagaauuggaggaaacucccuucaaggacaucguccgggguuguugu

SEQ ID NO: 3961 - RNA, 48 nt, Artificial Sequence
  Description of Artificial Sequence:  Enzymatic Nucleic Acid
uaauccuuggaggaaacucccuucaaggacaucguccgggugaagaau

SEQ ID NO: 3962 - RNA, 48 nt, Artificial Sequence
  Description of Artificial Sequence:  Enzymatic Nucleic Acid
ggauaaucggaggaaacucccuucaaggacaucguccggguucugaag

SEQ ID NO: 3963 - RNA, 48 nt, Artificial Sequence
  Description of Artificial Sequence:  Enzymatic Nucleic Acid
uggauaauggaggaaacucccuucaaggacaucguccgggcuucugaa

SEQ ID NO: 3964 - RNA, 48 nt, Artificial Sequence
  Description of Artificial Sequence:  Enzymatic Nucleic Acid
uaauucccggaggaaacucccuucaaggacaucguccgggauggauaa

SEQ ID NO: 3965 - RNA, 48 nt, Artificial Sequence
  Description of Artificial Sequence:  Enzymatic Nucleic Acid
guaauuccggaggaaacucccuucaaggacaucguccgggcauggaua

SEQ ID NO: 3966 - RNA, 48 nt, Artificial Sequence
  Description of Artificial Sequence:  Enzymatic Nucleic Acid
uguaauucggaggaaacucccuucaaggacaucguccgggccauggau

SEQ ID NO: 3967 - RNA, 48 nt, Artificial Sequence
  Description of Artificial Sequence:  Enzymatic Nucleic Acid
auguaauuggaggaaacucccuucaaggacaucguccgggcccaugga

SEQ ID NO: 3968 - RNA, 48 nt, Artificial Sequence
  Description of Artificial Sequence:  Enzymatic Nucleic Acid
gauaaggcggaggaaacucccuucaaggacaucguccggguauguaau

SEQ ID NO: 3969 - RNA, 48 nt, Artificial Sequence
  Description of Artificial Sequence:  Enzymatic Nucleic Acid
ugauaaggggaggaaacucccuucaaggacaucguccgggcuauguaa

SEQ ID NO: 3970 - RNA, 48 nt, Artificial Sequence
  Description of Artificial Sequence:  Enzymatic Nucleic Acid
gggcaauuggaggaaacucccuucaaggacaucguccggguauugaua

SEQ ID NO: 3971 - RNA, 48 nt, Artificial Sequence
  Description of Artificial Sequence:  Enzymatic Nucleic Acid
cuucugggggaggaaacucccuucaaggacaucguccgggaauucuau

SEQ ID NO: 3972 - RNA, 48 nt, Artificial Sequence
  Description of Artificial Sequence:  Enzymatic Nucleic Acid
cuuuucuuggaggaaacucccuucaaggacaucguccgggugggcaau

SEQ ID NO: 3973 - RNA, 48 nt, Artificial Sequence
  Description of Artificial Sequence:  Enzymatic Nucleic Acid
agucuuuuggaggaaacucccuucaaggacaucguccggguucugggc

SEQ ID NO: 3974 - RNA, 48 nt, Artificial Sequence
  Description of Artificial Sequence:  Enzymatic Nucleic Acid
caguuaguggaggaaacucccuucaaggacaucguccggguuuucuuc

SEQ ID NO: 3975 - RNA, 48 nt, Artificial Sequence
  Description of Artificial Sequence:  Enzymatic Nucleic Acid
auaauuuaggaggaaacucccuucaaggacaucguccgggaguuaguc

SEQ ID NO: 3976 - RNA, 48 nt, Artificial Sequence
  Description of Artificial Sequence:  Enzymatic Nucleic Acid
acacuguuggaggaaacucccuucaaggacaucguccgggauaauuua

SEQ ID NO: 3977 - RNA, 48 nt, Artificial Sequence
  Description of Artificial Sequence:  Enzymatic Nucleic Acid
gaugcacaggaggaaacucccuucaaggacaucguccggguguucaua

SEQ ID NO: 3978 - RNA, 48 nt, Artificial Sequence
  Description of Artificial Sequence:  Enzymatic Nucleic Acid
ccgaugcaggaggaaacucccuucaaggacaucguccgggacuguuca

SEQ ID NO: 3979 - RNA, 48 nt, Artificial Sequence
  Description of Artificial Sequence:  Enzymatic Nucleic Acid
ccccgaugggaggaaacucccuucaaggacaucguccgggacacuguu

SEQ ID NO: 3980 - RNA, 48 nt, Artificial Sequence
  Description of Artificial Sequence:  Enzymatic Nucleic Acid
ugcaccccggaggaaacucccuucaaggacaucguccggggaugcaca

SEQ ID NO: 3981 - RNA, 48 nt, Artificial Sequence
  Description of Artificial Sequence:  Enzymatic Nucleic Acid
augcacccggaggaaacucccuucaaggacaucguccgggcgaugcac

SEQ ID NO: 3982 - RNA, 48 nt, Artificial Sequence
  Description of Artificial Sequence:  Enzymatic Nucleic Acid
caugcaccggaggaaacucccuucaaggacaucguccgggccgaugca

SEQ ID NO: 3983 - RNA, 48 nt, Artificial Sequence
  Description of Artificial Sequence:  Enzymatic Nucleic Acid
ccaugcacggaggaaacucccuucaaggacaucguccgggcccgaugc

SEQ ID NO: 3984 - RNA, 48 nt, Artificial Sequence
  Description of Artificial Sequence:  Enzymatic Nucleic Acid
cccaugcaggaggaaacucccuucaaggacaucguccgggccccgaug

SEQ ID NO: 3985 - RNA, 48 nt, Artificial Sequence
  Description of Artificial Sequence:  Enzymatic Nucleic Acid
ggcccaugggaggaaacucccuucaaggacaucguccgggacccccga

SEQ ID NO: 3986 - RNA, 48 nt, Artificial Sequence
  Description of Artificial Sequence:  Enzymatic Nucleic Acid
uucuggccggaggaaacucccuucaaggacaucguccgggaugcaccc

SEQ ID NO: 3987 - RNA, 48 nt, Artificial Sequence
  Description of Artificial Sequence:  Enzymatic Nucleic Acid
cuucuggcggaggaaacucccuucaaggacaucguccgggcaugcacc

SEQ ID NO: 3988 - RNA, 48 nt, Artificial Sequence
  Description of Artificial Sequence:  Enzymatic Nucleic Acid
ccuucuggggaggaaacucccuucaaggacaucguccgggccaugcac

SEQ ID NO: 3989 - RNA, 48 nt, Artificial Sequence
  Description of Artificial Sequence:  Enzymatic Nucleic Acid
aaauccuuggaggaaacucccuucaaggacaucguccggguggcccau

SEQ ID NO: 3990 - RNA, 48 nt, Artificial Sequence
  Description of Artificial Sequence:  Enzymatic Nucleic Acid
augaaaucggaggaaacucccuucaaggacaucguccggguucuggcc

SEQ ID NO: 3991 - RNA, 48 nt, Artificial Sequence
  Description of Artificial Sequence:  Enzymatic Nucleic Acid
aaugaaauggaggaaacucccuucaaggacaucguccgggcuucuggc

SEQ ID NO: 3992 - RNA, 48 nt, Artificial Sequence
  Description of Artificial Sequence:  Enzymatic Nucleic Acid
ccauuuugggaggaaacucccuucaaggacaucguccgggauuuauaa

SEQ ID NO: 3993 - RNA, 48 nt, Artificial Sequence
  Description of Artificial Sequence:  Enzymatic Nucleic Acid
uucuguccggaggaaacucccuucaaggacaucguccgggauuuugca

SEQ ID NO: 3994 - RNA, 48 nt, Artificial Sequence
  Description of Artificial Sequence:  Enzymatic Nucleic Acid
uuucugucggaggaaacucccuucaaggacaucguccgggcauuuugc

SEQ ID NO: 3995 - RNA, 48 nt, Artificial Sequence
  Description of Artificial Sequence:  Enzymatic Nucleic Acid
cuuucuguggaggaaacucccuucaaggacaucguccgggccauuuug

SEQ ID NO: 3996 - RNA, 48 nt, Artificial Sequence
  Description of Artificial Sequence:  Enzymatic Nucleic Acid
uauucuuuggaggaaacucccuucaaggacaucguccgggugucccau

SEQ ID NO: 3997 - RNA, 48 nt, Artificial Sequence
  Description of Artificial Sequence:  Enzymatic Nucleic Acid
acuauauuggaggaaacucccuucaaggacaucguccggguuucuguc

SEQ ID NO: 3998 - RNA, 48 nt, Artificial Sequence
  Description of Artificial Sequence:  Enzymatic Nucleic Acid
uaccaauaggaggaaacucccuucaaggacaucguccggguauauucu

SEQ ID NO: 3999 - RNA, 48 nt, Artificial Sequence
  Description of Artificial Sequence:  Enzymatic Nucleic Acid
accuguacggaggaaacucccuucaaggacaucguccgggaauacuau

SEQ ID NO: 4000 - RNA, 48 nt, Artificial Sequence
  Description of Artificial Sequence:  Enzymatic Nucleic Acid
aaccuguaggaggaaacucccuucaaggacaucguccgggcaauacua

SEQ ID NO: 4001 - RNA, 48 nt, Artificial Sequence
  Description of Artificial Sequence:  Enzymatic Nucleic Acid
aguagaacggaggaaacucccuucaaggacaucguccggguguaccaa

SEQ ID NO: 4002 - RNA, 48 nt, Artificial Sequence
  Description of Artificial Sequence:  Enzymatic Nucleic Acid
uaguagaaggaggaaacucccuucaaggacaucguccgggcuguacca

SEQ ID NO: 4003 - RNA, 48 nt, Artificial Sequence
  Description of Artificial Sequence:  Enzymatic Nucleic Acid
uuugcuucggaggaaacucccuucaaggacaucguccggguguuuagu

SEQ ID NO: 4004 - RNA, 48 nt, Artificial Sequence
  Description of Artificial Sequence:  Enzymatic Nucleic Acid
uuuugcuuggaggaaacucccuucaaggacaucguccgggcuguuuag

SEQ ID NO: 4005 - RNA, 48 nt, Artificial Sequence
  Description of Artificial Sequence:  Enzymatic Nucleic Acid
uuguuuugggaggaaacucccuucaaggacaucguccggguuccuguu

SEQ ID NO: 4006 - RNA, 48 nt, Artificial Sequence
  Description of Artificial Sequence:  Enzymatic Nucleic Acid
uuagcggcggaggaaacucccuucaaggacaucguccgggaauuguuu

SEQ ID NO: 4007 - RNA, 48 nt, Artificial Sequence
  Description of Artificial Sequence:  Enzymatic Nucleic Acid
uuuagcggggaggaaacucccuucaaggacaucguccgggcaauuguu

SEQ ID NO: 4008 - RNA, 48 nt, Artificial Sequence
  Description of Artificial Sequence:  Enzymatic Nucleic Acid
aaguuuagggaggaaacucccuucaaggacaucguccgggggccaauu

SEQ ID NO: 4009 - RNA, 48 nt, Artificial Sequence
  Description of Artificial Sequence:  Enzymatic Nucleic Acid
aagauaugggaggaaacucccuucaaggacaucguccgggaaguuuag

SEQ ID NO: 4010 - RNA, 48 nt, Artificial Sequence
  Description of Artificial Sequence:  Enzymatic Nucleic Acid
gauaauauggaggaaacucccuucaaggacaucguccgggugaagaua

SEQ ID NO: 4011 - RNA, 48 nt, Artificial Sequence
  Description of Artificial Sequence:  Enzymatic Nucleic Acid
gguuucuuggaggaaacucccuucaaggacaucguccgggugauaaua

SEQ ID NO: 4012 - RNA, 48 nt, Artificial Sequence
  Description of Artificial Sequence:  Enzymatic Nucleic Acid
ugagguuuggaggaaacucccuucaaggacaucguccggguucugaua

SEQ ID NO: 4013 - RNA, 48 nt, Artificial Sequence
  Description of Artificial Sequence:  Enzymatic Nucleic Acid
agauuucaggaggaaacucccuucaaggacaucguccgggugagguuu

SEQ ID NO: 4014 - RNA, 48 nt, Artificial Sequence
  Description of Artificial Sequence:  Enzymatic Nucleic Acid
ucagauuuggaggaaacucccuucaaggacaucguccgggacugaggu

SEQ ID NO: 4015 - RNA, 48 nt, Artificial Sequence
  Description of Artificial Sequence:  Enzymatic Nucleic Acid
cagguaguggaggaaacucccuucaaggacaucguccgggagauuuca

SEQ ID NO: 4016 - RNA, 48 nt, Artificial Sequence
  Description of Artificial Sequence:  Enzymatic Nucleic Acid
ccagaggaggaggaaacucccuucaaggacaucguccgggagguaguc

SEQ ID NO: 4017 - RNA, 48 nt, Artificial Sequence
  Description of Artificial Sequence:  Enzymatic Nucleic Acid
aaaagaacggaggaaacucccuucaaggacaucguccgggagaggaca

SEQ ID NO: 4018 - RNA, 48 nt, Artificial Sequence
  Description of Artificial Sequence:  Enzymatic Nucleic Acid
caaaagaaggaggaaacucccuucaaggacaucguccgggcagaggac

SEQ ID NO: 4019 - RNA, 48 nt, Artificial Sequence
  Description of Artificial Sequence:  Enzymatic Nucleic Acid
cguaguagggaggaaacucccuucaaggacaucguccgggaaaagaac

SEQ ID NO: 4020 - RNA, 48 nt, Artificial Sequence
  Description of Artificial Sequence:  Enzymatic Nucleic Acid
gacucacaggaggaaacucccuucaaggacaucguccgggguaguagc

SEQ ID NO: 4021 - RNA, 48 nt, Artificial Sequence
  Description of Artificial Sequence:  Enzymatic Nucleic Acid
gggacucaggaggaaacucccuucaaggacaucguccgggacguagua

SEQ ID NO: 4022 - RNA, 48 nt, Artificial Sequence
  Description of Artificial Sequence:  Enzymatic Nucleic Acid
uugggacuggaggaaacucccuucaaggacaucguccgggacacguag

SEQ ID NO: 4023 - RNA, 48 nt, Artificial Sequence
  Description of Artificial Sequence:  Enzymatic Nucleic Acid
cuuugggaggaggaaacucccuucaaggacaucguccgggucacacgu

SEQ ID NO: 4024 - RNA, 48 nt, Artificial Sequence
  Description of Artificial Sequence:  Enzymatic Nucleic Acid
aagaguugggaggaaacucccuucaaggacaucguccggguuugggac

SEQ ID NO: 4025 - RNA, 48 nt, Artificial Sequence
  Description of Artificial Sequence:  Enzymatic Nucleic Acid
gcuggucaggaggaaacucccuucaaggacaucguccggguaaagagu

SEQ ID NO: 4026 - RNA, 48 nt, Artificial Sequence
  Description of Artificial Sequence:  Enzymatic Nucleic Acid
gugcugguggaggaaacucccuucaaggacaucguccgggacuaaaga

SEQ ID NO: 4027 - RNA, 48 nt, Artificial Sequence
  Description of Artificial Sequence:  Enzymatic Nucleic Acid
cgagugugggaggaaacucccuucaaggacaucguccggguggucacu

SEQ ID NO: 4028 - RNA, 48 nt, Artificial Sequence
  Description of Artificial Sequence:  Enzymatic Nucleic Acid
uucagaagggaggaaacucccuucaaggacaucguccggggagugugc

SEQ ID NO: 4029 - RNA, 48 nt, Artificial Sequence
  Description of Artificial Sequence:  Enzymatic Nucleic Acid
ugaugauuggaggaaacucccuucaaggacaucguccgggagaagcga

SEQ ID NO: 4030 - RNA, 48 nt, Artificial Sequence
  Description of Artificial Sequence:  Enzymatic Nucleic Acid
gucaccuuggaggaaacucccuucaaggacaucguccgggagaugaug

SEQ ID NO: 4031 - RNA, 48 nt, Artificial Sequence
  Description of Artificial Sequence:  Enzymatic Nucleic Acid
gaagucacggaggaaacucccuucaaggacaucguccggguucagaug

SEQ ID NO: 4032 - RNA, 48 nt, Artificial Sequence
  Description of Artificial Sequence:  Enzymatic Nucleic Acid
agaagucaggaggaaacucccuucaaggacaucguccgggcuucagau

SEQ ID NO: 4033 - RNA, 48 nt, Artificial Sequence
  Description of Artificial Sequence:  Enzymatic Nucleic Acid
ugagaaguggaggaaacucccuucaaggacaucguccgggaccuucag

SEQ ID NO: 4034 - RNA, 48 nt, Artificial Sequence
  Description of Artificial Sequence:  Enzymatic Nucleic Acid
uguaucugggaggaaacucccuucaaggacaucguccgggugagaagu

SEQ ID NO: 4035 - RNA, 48 nt, Artificial Sequence
  Description of Artificial Sequence:  Enzymatic Nucleic Acid
ugauguauggaggaaacucccuucaaggacaucguccgggugcugaga

SEQ ID NO: 4036 - RNA, 48 nt, Artificial Sequence
  Description of Artificial Sequence:  Enzymatic Nucleic Acid
auuuaucuggaggaaacucccuucaaggacaucguccgggugauguau

SEQ ID NO: 4037 - RNA, 48 nt, Artificial Sequence
  Description of Artificial Sequence:  Enzymatic Nucleic Acid
gaauuuauggaggaaacucccuucaaggacaucguccgggucugaugu

SEQ ID NO: 4038 - RNA, 48 nt, Artificial Sequence
  Description of Artificial Sequence:  Enzymatic Nucleic Acid
aacugucaggaggaaacucccuucaaggacaucguccggguguuagaa

SEQ ID NO: 4039 - RNA, 48 nt, Artificial Sequence
  Description of Artificial Sequence:  Enzymatic Nucleic Acid
uaaacuguggaggaaacucccuucaaggacaucguccgggacuguuag

SEQ ID NO: 4040 - RNA, 48 nt, Artificial Sequence
  Description of Artificial Sequence:  Enzymatic Nucleic Acid
uguuuaaaggaggaaacucccuucaaggacaucguccgggugucacug

SEQ ID NO: 4041 - RNA, 48 nt, Artificial Sequence
  Description of Artificial Sequence:  Enzymatic Nucleic Acid
acgaagaaggaggaaacucccuucaaggacaucguccggguguuuaaa

SEQ ID NO: 4042 - RNA, 48 nt, Artificial Sequence
  Description of Artificial Sequence:  Enzymatic Nucleic Acid
auaagcaaggaggaaacucccuucaaggacaucguccggggaagaacu

SEQ ID NO: 4043 - RNA, 48 nt, Artificial Sequence
  Description of Artificial Sequence:  Enzymatic Nucleic Acid
uucauaagggaggaaacucccuucaaggacaucguccgggaacgaaga

SEQ ID NO: 4044 - RNA, 48 nt, Artificial Sequence
  Description of Artificial Sequence:  Enzymatic Nucleic Acid
agaccauuggaggaaacucccuucaaggacaucguccgggauaagcaa

SEQ ID NO: 4045 - RNA, 48 nt, Artificial Sequence
  Description of Artificial Sequence:  Enzymatic Nucleic Acid
ucugagacggaggaaacucccuucaaggacaucguccgggauucauaa

SEQ ID NO: 4046 - RNA, 48 nt, Artificial Sequence
  Description of Artificial Sequence:  Enzymatic Nucleic Acid
uucugagaggaggaaacucccuucaaggacaucguccgggcauucaua

SEQ ID NO: 4047 - RNA, 48 nt, Artificial Sequence
  Description of Artificial Sequence:  Enzymatic Nucleic Acid
gauuauuuggaggaaacucccuucaaggacaucguccgggugagacca

SEQ ID NO: 4048 - RNA, 48 nt, Artificial Sequence
  Description of Artificial Sequence:  Enzymatic Nucleic Acid
uugccuucggaggaaacucccuucaaggacaucguccggguuugauua

SEQ ID NO: 4049 - RNA, 48 nt, Artificial Sequence
  Description of Artificial Sequence:  Enzymatic Nucleic Acid
uuugccuuggaggaaacucccuucaaggacaucguccgggcuuugauu

SEQ ID NO: 4050 - RNA, 48 nt, Artificial Sequence
  Description of Artificial Sequence:  Enzymatic Nucleic Acid
cuuuuugcggaggaaacucccuucaaggacaucguccggguuccuuug

SEQ ID NO: 4051 - RNA, 48 nt, Artificial Sequence
  Description of Artificial Sequence:  Enzymatic Nucleic Acid
ucuuuuugggaggaaacucccuucaaggacaucguccgggcuuccuuu

SEQ ID NO: 4052 - RNA, 48 nt, Artificial Sequence
  Description of Artificial Sequence:  Enzymatic Nucleic Acid
ccaaagauggaggaaacucccuucaaggacaucguccggguuuuugcc

SEQ ID NO: 4053 - RNA, 48 nt, Artificial Sequence
  Description of Artificial Sequence:  Enzymatic Nucleic Acid
cugggugcggaggaaacucccuucaaggacaucguccgggaaagaucu

SEQ ID NO: 4054 - RNA, 48 nt, Artificial Sequence
  Description of Artificial Sequence:  Enzymatic Nucleic Acid
ucugggugggaggaaacucccuucaaggacaucguccgggcaaagauc

SEQ ID NO: 4055 - RNA, 48 nt, Artificial Sequence
  Description of Artificial Sequence:  Enzymatic Nucleic Acid
ggucaaauggaggaaacucccuucaaggacaucguccgggugggugcc

SEQ ID NO: 4056 - RNA, 48 nt, Artificial Sequence
  Description of Artificial Sequence:  Enzymatic Nucleic Acid
aggaagguggaggaaacucccuucaaggacaucguccgggaaaucugg

SEQ ID NO: 4057 - RNA, 48 nt, Artificial Sequence
  Description of Artificial Sequence:  Enzymatic Nucleic Acid
uuucauguggaggaaacucccuucaaggacaucguccgggaggaaggu

SEQ ID NO: 4058 - RNA, 48 nt, Artificial Sequence
  Description of Artificial Sequence:  Enzymatic Nucleic Acid
guuucuuuggaggaaacucccuucaaggacaucguccgggaugucagg

SEQ ID NO: 4059 - RNA, 48 nt, Artificial Sequence
  Description of Artificial Sequence:  Enzymatic Nucleic Acid
cuuuguuuggaggaaacucccuucaaggacaucguccggguuucaugu

SEQ ID NO: 4060 - RNA, 48 nt, Artificial Sequence
  Description of Artificial Sequence:  Enzymatic Nucleic Acid
acaguauaggaggaaacucccuucaaggacaucguccggguuuguuuc

SEQ ID NO: 4061 - RNA, 48 nt, Artificial Sequence
  Description of Artificial Sequence:  Enzymatic Nucleic Acid
cuuguccaggaggaaacucccuucaaggacaucguccgggaguauacu

SEQ ID NO: 4062 - RNA, 48 nt, Artificial Sequence
  Description of Artificial Sequence:  Enzymatic Nucleic Acid
cucuugucggaggaaacucccuucaaggacaucguccgggacaguaua

SEQ ID NO: 4063 - RNA, 48 nt, Artificial Sequence
  Description of Artificial Sequence:  Enzymatic Nucleic Acid
ccucuuguggaggaaacucccuucaaggacaucguccgggcacaguau

SEQ ID NO: 4064 - RNA, 48 nt, Artificial Sequence
  Description of Artificial Sequence:  Enzymatic Nucleic Acid
ccaaaccuggaggaaacucccuucaaggacaucguccggguuguccac

SEQ ID NO: 4065 - RNA, 48 nt, Artificial Sequence
  Description of Artificial Sequence:  Enzymatic Nucleic Acid
ugccaaacggaggaaacucccuucaaggacaucguccgggucuugucc

SEQ ID NO: 4066 - RNA, 48 nt, Artificial Sequence
  Description of Artificial Sequence:  Enzymatic Nucleic Acid
augccaaaggaggaaacucccuucaaggacaucguccgggcucuuguc

SEQ ID NO: 4067 - RNA, 48 nt, Artificial Sequence
  Description of Artificial Sequence:  Enzymatic Nucleic Acid
auccaugcggaggaaacucccuucaaggacaucguccgggaaaccucu

SEQ ID NO: 4068 - RNA, 48 nt, Artificial Sequence
  Description of Artificial Sequence:  Enzymatic Nucleic Acid
aauccaugggaggaaacucccuucaaggacaucguccgggcaaaccuc

SEQ ID NO: 4069 - RNA, 48 nt, Artificial Sequence
  Description of Artificial Sequence:  Enzymatic Nucleic Acid
uuaaaaucggaggaaacucccuucaaggacaucguccgggaugccaaa

SEQ ID NO: 4070 - RNA, 48 nt, Artificial Sequence
  Description of Artificial Sequence:  Enzymatic Nucleic Acid
uuuaaaauggaggaaacucccuucaaggacaucguccgggcaugccaa

SEQ ID NO: 4071 - RNA, 48 nt, Artificial Sequence
  Description of Artificial Sequence:  Enzymatic Nucleic Acid
uucuauuuggaggaaacucccuucaaggacaucguccggguuuaaaau

SEQ ID NO: 4072 - RNA, 48 nt, Artificial Sequence
  Description of Artificial Sequence:  Enzymatic Nucleic Acid
aauuaauuggaggaaacucccuucaaggacaucguccggguauuucuu

SEQ ID NO: 4073 - RNA, 48 nt, Artificial Sequence
  Description of Artificial Sequence:  Enzymatic Nucleic Acid
accugagcggaggaaacucccuucaaggacaucguccgggaauuaauu

SEQ ID NO: 4074 - RNA, 48 nt, Artificial Sequence
  Description of Artificial Sequence:  Enzymatic Nucleic Acid
caccugagggaggaaacucccuucaaggacaucguccgggcaauuaau

SEQ ID NO: 4075 - RNA, 48 nt, Artificial Sequence
  Description of Artificial Sequence:  Enzymatic Nucleic Acid
aaauccacggaggaaacucccuucaaggacaucguccgggugagccaa

SEQ ID NO: 4076 - RNA, 48 nt, Artificial Sequence
  Description of Artificial Sequence:  Enzymatic Nucleic Acid
caaauccaggaggaaacucccuucaaggacaucguccgggcugagcca

SEQ ID NO: 4077 - RNA, 48 nt, Artificial Sequence
  Description of Artificial Sequence:  Enzymatic Nucleic Acid
gccaaaucggaggaaacucccuucaaggacaucguccgggaccugagc

SEQ ID NO: 4078 - RNA, 48 nt, Artificial Sequence
  Description of Artificial Sequence:  Enzymatic Nucleic Acid
ggccaaauggaggaaacucccuucaaggacaucguccgggcaccugag

SEQ ID NO: 4079 - RNA, 48 nt, Artificial Sequence
  Description of Artificial Sequence:  Enzymatic Nucleic Acid
aacuuggcggaggaaacucccuucaaggacaucguccgggaaauccac

SEQ ID NO: 4080 - RNA, 48 nt, Artificial Sequence
  Description of Artificial Sequence:  Enzymatic Nucleic Acid
aaacuuggggaggaaacucccuucaaggacaucguccgggcaaaucca

SEQ ID NO: 4081 - RNA, 48 nt, Artificial Sequence
  Description of Artificial Sequence:  Enzymatic Nucleic Acid
uuugaaaaggaggaaacucccuucaaggacaucguccggguuggccaa

SEQ ID NO: 4082 - RNA, 48 nt, Artificial Sequence
  Description of Artificial Sequence:  Enzymatic Nucleic Acid
guguuuugggaggaaacucccuucaaggacaucguccggguuugaaaa

SEQ ID NO: 4083 - RNA, 48 nt, Artificial Sequence
  Description of Artificial Sequence:  Enzymatic Nucleic Acid
cgucaauuggaggaaacucccuucaaggacaucguccggguguguuuu

SEQ ID NO: 4084 - RNA, 48 nt, Artificial Sequence
  Description of Artificial Sequence:  Enzymatic Nucleic Acid
cuuuccguggaggaaacucccuucaaggacaucguccgggaauucugu

SEQ ID NO: 4085 - RNA, 48 nt, Artificial Sequence
  Description of Artificial Sequence:  Enzymatic Nucleic Acid
agucuuucggaggaaacucccuucaaggacaucguccggggucaauuc

SEQ ID NO: 4086 - RNA, 48 nt, Artificial Sequence
  Description of Artificial Sequence:  Enzymatic Nucleic Acid
aagucuuuggaggaaacucccuucaaggacaucguccgggcgucaauu

SEQ ID NO: 4087 - RNA, 48 nt, Artificial Sequence
  Description of Artificial Sequence:  Enzymatic Nucleic Acid
acguaaguggaggaaacucccuucaaggacaucguccggguuuccguc

SEQ ID NO: 4088 - RNA, 48 nt, Artificial Sequence
  Description of Artificial Sequence:  Enzymatic Nucleic Acid
uuuaauaaggaggaaacucccuucaaggacaucguccgggguaagucu

SEQ ID NO: 4089 - RNA, 48 nt, Artificial Sequence
  Description of Artificial Sequence:  Enzymatic Nucleic Acid
auuuaacaggaggaaacucccuucaaggacaucguccgggguuuaaua

SEQ ID NO: 4090 - RNA, 48 nt, Artificial Sequence
  Description of Artificial Sequence:  Enzymatic Nucleic Acid
auauuuaaggaggaaacucccuucaaggacaucguccgggacguuuaa

SEQ ID NO: 4091 - RNA, 48 nt, Artificial Sequence
  Description of Artificial Sequence:  Enzymatic Nucleic Acid
cgccuucuggaggaaacucccuucaaggacaucguccgggguuauuau

SEQ ID NO: 4092 - RNA, 48 nt, Artificial Sequence
  Description of Artificial Sequence:  Enzymatic Nucleic Acid
uccgccuuggaggaaacucccuucaaggacaucguccgggucguuauu

SEQ ID NO: 4093 - RNA, 48 nt, Artificial Sequence
  Description of Artificial Sequence:  Enzymatic Nucleic Acid
cgcuccgcggaggaaacucccuucaaggacaucguccggguucucguu

SEQ ID NO: 4094 - RNA, 48 nt, Artificial Sequence
  Description of Artificial Sequence:  Enzymatic Nucleic Acid
acgcuccgggaggaaacucccuucaaggacaucguccgggcuucucgu

SEQ ID NO: 4095 - RNA, 48 nt, Artificial Sequence
  Description of Artificial Sequence:  Enzymatic Nucleic Acid
ucacgcucggaggaaacucccuucaaggacaucguccggggccuucuc

SEQ ID NO: 4096 - RNA, 48 nt, Artificial Sequence
  Description of Artificial Sequence:  Enzymatic Nucleic Acid
uucacgcuggaggaaacucccuucaaggacaucguccgggcgccuucu

SEQ ID NO: 4097 - RNA, 48 nt, Artificial Sequence
  Description of Artificial Sequence:  Enzymatic Nucleic Acid
acuucacgggaggaaacucccuucaaggacaucguccggguccgccuu

SEQ ID NO: 4098 - RNA, 48 nt, Artificial Sequence
  Description of Artificial Sequence:  Enzymatic Nucleic Acid
uuacuucaggaggaaacucccuucaaggacaucguccggggcuccgcc

SEQ ID NO: 4099 - RNA, 48 nt, Artificial Sequence
  Description of Artificial Sequence:  Enzymatic Nucleic Acid
uuuuacuuggaggaaacucccuucaaggacaucguccgggacgcuccg

SEQ ID NO: 4100 - RNA, 48 nt, Artificial Sequence
  Description of Artificial Sequence:  Enzymatic Nucleic Acid
ugcuuuuaggaggaaacucccuucaaggacaucguccggguucacgcu

SEQ ID NO: 4101 - RNA, 48 nt, Artificial Sequence
  Description of Artificial Sequence:  Enzymatic Nucleic Acid
ugccaaugggaggaaacucccuucaaggacaucguccggguuuuacuu

SEQ ID NO: 4102 - RNA, 48 nt, Artificial Sequence
  Description of Artificial Sequence:  Enzymatic Nucleic Acid
aguuuugcggaggaaacucccuucaaggacaucguccgggaaugcuuu

SEQ ID NO: 4103 - RNA, 48 nt, Artificial Sequence
  Description of Artificial Sequence:  Enzymatic Nucleic Acid
aaguuuugggaggaaacucccuucaaggacaucguccgggcaaugcuu

SEQ ID NO: 4104 - RNA, 48 nt, Artificial Sequence
  Description of Artificial Sequence:  Enzymatic Nucleic Acid
uacaugauggaggaaacucccuucaaggacaucguccgggaaguuuug

SEQ ID NO: 4105 - RNA, 48 nt, Artificial Sequence
  Description of Artificial Sequence:  Enzymatic Nucleic Acid
aauauuuaggaggaaacucccuucaaggacaucguccgggaugaucaa

SEQ ID NO: 4106 - RNA, 48 nt, Artificial Sequence
  Description of Artificial Sequence:  Enzymatic Nucleic Acid
guagugaaggaggaaacucccuucaaggacaucguccgggaauauuua

SEQ ID NO: 4107 - RNA, 48 nt, Artificial Sequence
  Description of Artificial Sequence:  Enzymatic Nucleic Acid
ccaacagcggaggaaacucccuucaaggacaucguccgggauuguagu

SEQ ID NO: 4108 - RNA, 48 nt, Artificial Sequence
  Description of Artificial Sequence:  Enzymatic Nucleic Acid
cccaacagggaggaaacucccuucaaggacaucguccgggcauuguag

SEQ ID NO: 4109 - RNA, 48 nt, Artificial Sequence
  Description of Artificial Sequence:  Enzymatic Nucleic Acid
caucccaaggaggaaacucccuucaaggacaucguccgggagccauug

SEQ ID NO: 4110 - RNA, 48 nt, Artificial Sequence
  Description of Artificial Sequence:  Enzymatic Nucleic Acid
auccauccggaggaaacucccuucaaggacaucguccgggaacagcca

SEQ ID NO: 4111 - RNA, 48 nt, Artificial Sequence
  Description of Artificial Sequence:  Enzymatic Nucleic Acid
aauccaucggaggaaacucccuucaaggacaucguccgggcaacagcc

SEQ ID NO: 4112 - RNA, 48 nt, Artificial Sequence
  Description of Artificial Sequence:  Enzymatic Nucleic Acid
aaauccauggaggaaacucccuucaaggacaucguccgggccaacagc

SEQ ID NO: 4113 - RNA, 48 nt, Artificial Sequence
  Description of Artificial Sequence:  Enzymatic Nucleic Acid
aucaaaucggaggaaacucccuucaaggacaucguccgggaucccaac

SEQ ID NO: 4114 - RNA, 48 nt, Artificial Sequence
  Description of Artificial Sequence:  Enzymatic Nucleic Acid
aaucaaauggaggaaacucccuucaaggacaucguccgggcaucccaa

SEQ ID NO: 4115 - RNA, 48 nt, Artificial Sequence
  Description of Artificial Sequence:  Enzymatic Nucleic Acid
aucauaauggaggaaacucccuucaaggacaucguccgggaaauccau

SEQ ID NO: 4116 - RNA, 48 nt, Artificial Sequence
  Description of Artificial Sequence:  Enzymatic Nucleic Acid
cucaggauggaggaaacucccuucaaggacaucguccgggauaaucaa

SEQ ID NO: 4117 - RNA, 48 nt, Artificial Sequence
  Description of Artificial Sequence:  Enzymatic Nucleic Acid
acuggucuggaggaaacucccuucaaggacaucguccgggaggaucau

SEQ ID NO: 4118 - RNA, 48 nt, Artificial Sequence
  Description of Artificial Sequence:  Enzymatic Nucleic Acid
ucacugguggaggaaacucccuucaaggacaucguccgggucaggauc

SEQ ID NO: 4119 - RNA, 48 nt, Artificial Sequence
  Description of Artificial Sequence:  Enzymatic Nucleic Acid
aaucaucaggaggaaacucccuucaaggacaucguccggguggucuca

SEQ ID NO: 4120 - RNA, 48 nt, Artificial Sequence
  Description of Artificial Sequence:  Enzymatic Nucleic Acid
agaaucauggaggaaacucccuucaaggacaucguccgggacuggucu

SEQ ID NO: 4121 - RNA, 48 nt, Artificial Sequence
  Description of Artificial Sequence:  Enzymatic Nucleic Acid
aagagaauggaggaaacucccuucaaggacaucguccgggaucacugg

SEQ ID NO: 4122 - RNA, 48 nt, Artificial Sequence
  Description of Artificial Sequence:  Enzymatic Nucleic Acid
acugcucuggaggaaacucccuucaaggacaucguccgggaagagaau

SEQ ID NO: 4123 - RNA, 48 nt, Artificial Sequence
  Description of Artificial Sequence:  Enzymatic Nucleic Acid
ucacugcuggaggaaacucccuucaaggacaucguccgggucaagaga

SEQ ID NO: 4124 - RNA, 48 nt, Artificial Sequence
  Description of Artificial Sequence:  Enzymatic Nucleic Acid
aaucacugggaggaaacucccuucaaggacaucguccgggucucaaga

SEQ ID NO: 4125 - RNA, 48 nt, Artificial Sequence
  Description of Artificial Sequence:  Enzymatic Nucleic Acid
cauaaucaggaggaaacucccuucaaggacaucguccgggugcucuca

SEQ ID NO: 4126 - RNA, 48 nt, Artificial Sequence
  Description of Artificial Sequence:  Enzymatic Nucleic Acid
aucauaauggaggaaacucccuucaaggacaucguccgggacugcucu

SEQ ID NO: 4127 - RNA, 48 nt, Artificial Sequence
  Description of Artificial Sequence:  Enzymatic Nucleic Acid
cucaggauggaggaaacucccuucaaggacaucguccgggauaaucac

SEQ ID NO: 4128 - RNA, 48 nt, Artificial Sequence
  Description of Artificial Sequence:  Enzymatic Nucleic Acid
gcuguucuggaggaaacucccuucaaggacaucguccgggaggaucau

SEQ ID NO: 4129 - RNA, 48 nt, Artificial Sequence
  Description of Artificial Sequence:  Enzymatic Nucleic Acid
uugcuguuggaggaaacucccuucaaggacaucguccgggucaggauc

SEQ ID NO: 4130 - RNA, 48 nt, Artificial Sequence
  Description of Artificial Sequence:  Enzymatic Nucleic Acid
uauuuuugggaggaaacucccuucaaggacaucguccggguguucuca

SEQ ID NO: 4131 - RNA, 48 nt, Artificial Sequence
  Description of Artificial Sequence:  Enzymatic Nucleic Acid
accuugaaggaggaaacucccuucaaggacaucguccggguauuuuug

SEQ ID NO: 4132 - RNA, 48 nt, Artificial Sequence
  Description of Artificial Sequence:  Enzymatic Nucleic Acid
ucuuugacggaggaaacucccuucaaggacaucguccggguugaacua

SEQ ID NO: 4133 - RNA, 48 nt, Artificial Sequence
  Description of Artificial Sequence:  Enzymatic Nucleic Acid
gucuuugaggaggaaacucccuucaaggacaucguccgggcuugaacu

SEQ ID NO: 4134 - RNA, 48 nt, Artificial Sequence
  Description of Artificial Sequence:  Enzymatic Nucleic Acid
cacuuaguggaggaaacucccuucaaggacaucguccggguuugaccu

SEQ ID NO: 4135 - RNA, 48 nt, Artificial Sequence
  Description of Artificial Sequence:  Enzymatic Nucleic Acid
aaaaggcaggaggaaacucccuucaaggacaucguccggguuagucuu

SEQ ID NO: 4136 - RNA, 48 nt, Artificial Sequence
  Description of Artificial Sequence:  Enzymatic Nucleic Acid
ugaaaaggggaggaaacucccuucaaggacaucguccgggacuuaguc

SEQ ID NO: 4137 - RNA, 48 nt, Artificial Sequence
  Description of Artificial Sequence:  Enzymatic Nucleic Acid
cagaauucggaggaaacucccuucaaggacaucguccgggauuuggau

SEQ ID NO: 4138 - RNA, 48 nt, Artificial Sequence
  Description of Artificial Sequence:  Enzymatic Nucleic Acid
acagaauuggaggaaacucccuucaaggacaucguccgggcauuugga

SEQ ID NO: 4139 - RNA, 48 nt, Artificial Sequence
  Description of Artificial Sequence:  Enzymatic Nucleic Acid
cuuuaucaggaggaaacucccuucaaggacaucguccgggagaauucc

SEQ ID NO: 4140 - RNA, 48 nt, Artificial Sequence
  Description of Artificial Sequence:  Enzymatic Nucleic Acid
cccuuuauggaggaaacucccuucaaggacaucguccgggacagaauu

SEQ ID NO: 4141 - RNA, 48 nt, Artificial Sequence
  Description of Artificial Sequence:  Enzymatic Nucleic Acid
caagguccggaggaaacucccuucaaggacaucguccggguuuaucac

SEQ ID NO: 4142 - RNA, 48 nt, Artificial Sequence
  Description of Artificial Sequence:  Enzymatic Nucleic Acid
ccaaggucggaggaaacucccuucaaggacaucguccgggcuuuauca

SEQ ID NO: 4143 - RNA, 48 nt, Artificial Sequence
  Description of Artificial Sequence:  Enzymatic Nucleic Acid
uccaagguggaggaaacucccuucaaggacaucguccgggccuuuauc

SEQ ID NO: 4144 - RNA, 48 nt, Artificial Sequence
  Description of Artificial Sequence:  Enzymatic Nucleic Acid
cauuguucggaggaaacucccuucaaggacaucguccgggaagguccc

SEQ ID NO: 4145 - RNA, 48 nt, Artificial Sequence
  Description of Artificial Sequence:  Enzymatic Nucleic Acid
ccauuguuggaggaaacucccuucaaggacaucguccgggcaaggucc

SEQ ID NO: 4146 - RNA, 48 nt, Artificial Sequence
  Description of Artificial Sequence:  Enzymatic Nucleic Acid
uuucaaucggaggaaacucccuucaaggacaucguccgggauuguucc

SEQ ID NO: 4147 - RNA, 48 nt, Artificial Sequence
  Description of Artificial Sequence:  Enzymatic Nucleic Acid
uuuucaauggaggaaacucccuucaaggacaucguccgggcauuguuc

SEQ ID NO: 4148 - RNA, 48 nt, Artificial Sequence
  Description of Artificial Sequence:  Enzymatic Nucleic Acid
ucuuuuuuggaggaaacucccuucaaggacaucguccgggaauccauu

SEQ ID NO: 4149 - RNA, 48 nt, Artificial Sequence
  Description of Artificial Sequence:  Enzymatic Nucleic Acid
cgccucuuggaggaaacucccuucaaggacaucguccggguuuuuuca

SEQ ID NO: 4150 - RNA, 48 nt, Artificial Sequence
  Description of Artificial Sequence:  Enzymatic Nucleic Acid
ucucgccuggaggaaacucccuucaaggacaucguccggguucuuuuu

SEQ ID NO: 4151 - RNA, 48 nt, Artificial Sequence
  Description of Artificial Sequence:  Enzymatic Nucleic Acid
uuucucgcggaggaaacucccuucaaggacaucguccgggucuucuuu

SEQ ID NO: 4152 - RNA, 48 nt, Artificial Sequence
  Description of Artificial Sequence:  Enzymatic Nucleic Acid
guuucucgggaggaaacucccuucaaggacaucguccgggcucuucuu

SEQ ID NO: 4153 - RNA, 48 nt, Artificial Sequence
  Description of Artificial Sequence:  Enzymatic Nucleic Acid
uaguuucuggaggaaacucccuucaaggacaucguccggggccucuuc

SEQ ID NO: 4154 - RNA, 48 nt, Artificial Sequence
  Description of Artificial Sequence:  Enzymatic Nucleic Acid
ucuaguuuggaggaaacucccuucaaggacaucguccgggucgccucu

SEQ ID NO: 4155 - RNA, 48 nt, Artificial Sequence
  Description of Artificial Sequence:  Enzymatic Nucleic Acid
aacuuuguggaggaaacucccuucaaggacaucguccggguaguuucu

SEQ ID NO: 4156 - RNA, 48 nt, Artificial Sequence
  Description of Artificial Sequence:  Enzymatic Nucleic Acid
agccaaaaggaggaaacucccuucaaggacaucguccggguuugucua

SEQ ID NO: 4157 - RNA, 48 nt, Artificial Sequence
  Description of Artificial Sequence:  Enzymatic Nucleic Acid
uccaaagcggaggaaacucccuucaaggacaucguccgggaaaacuuu

SEQ ID NO: 4158 - RNA, 48 nt, Artificial Sequence
  Description of Artificial Sequence:  Enzymatic Nucleic Acid
uuccaaagggaggaaacucccuucaaggacaucguccgggcaaaacuu

SEQ ID NO: 4159 - RNA, 48 nt, Artificial Sequence
  Description of Artificial Sequence:  Enzymatic Nucleic Acid
aagaguucggaggaaacucccuucaaggacaucguccgggaaagccaa

SEQ ID NO: 4160 - RNA, 48 nt, Artificial Sequence
  Description of Artificial Sequence:  Enzymatic Nucleic Acid
aaagaguuggaggaaacucccuucaaggacaucguccgggcaaagcca

SEQ ID NO: 4161 - RNA, 48 nt, Artificial Sequence
  Description of Artificial Sequence:  Enzymatic Nucleic Acid
uauuuguuggaggaaacucccuucaaggacaucguccgggaaagaguu

SEQ ID NO: 4162 - RNA, 48 nt, Artificial Sequence
  Description of Artificial Sequence:  Enzymatic Nucleic Acid
auccacccggaggaaacucccuucaaggacaucguccggguuuuguua

SEQ ID NO: 4163 - RNA, 48 nt, Artificial Sequence
  Description of Artificial Sequence:  Enzymatic Nucleic Acid
aauccaccggaggaaacucccuucaaggacaucguccgggcuuuuguu

SEQ ID NO: 4164 - RNA, 48 nt, Artificial Sequence
  Description of Artificial Sequence:  Enzymatic Nucleic Acid
uaauccacggaggaaacucccuucaaggacaucguccgggccuuuugu

SEQ ID NO: 4165 - RNA, 48 nt, Artificial Sequence
  Description of Artificial Sequence:  Enzymatic Nucleic Acid
auaauccaggaggaaacucccuucaaggacaucguccgggcccuuuug

SEQ ID NO: 4166 - RNA, 48 nt, Artificial Sequence
  Description of Artificial Sequence:  Enzymatic Nucleic Acid
auauaaucggaggaaacucccuucaaggacaucguccgggaccccuuu

SEQ ID NO: 4167 - RNA, 48 nt, Artificial Sequence
  Description of Artificial Sequence:  Enzymatic Nucleic Acid
uauauaauggaggaaacucccuucaaggacaucguccgggcaccccuu

SEQ ID NO: 4168 - RNA, 48 nt, Artificial Sequence
  Description of Artificial Sequence:  Enzymatic Nucleic Acid
uaagaucuggaggaaacucccuucaaggacaucguccggguaugaauu

SEQ ID NO: 4169 - RNA, 48 nt, Artificial Sequence
  Description of Artificial Sequence:  Enzymatic Nucleic Acid
cuuaagauggaggaaacucccuucaaggacaucguccgggucuaugaa

SEQ ID NO: 4170 - RNA, 48 nt, Artificial Sequence
  Description of Artificial Sequence:  Enzymatic Nucleic Acid
uuacuuggggaggaaacucccuucaaggacaucguccggguuaagauc

SEQ ID NO: 4171 - RNA, 48 nt, Artificial Sequence
  Description of Artificial Sequence:  Enzymatic Nucleic Acid
auauauuaggaggaaacucccuucaaggacaucguccggguuggcuua

SEQ ID NO: 4172 - RNA, 48 nt, Artificial Sequence
  Description of Artificial Sequence:  Enzymatic Nucleic Acid
uguaucuaggaggaaacucccuucaaggacaucguccggguaagaaua

SEQ ID NO: 4173 - RNA, 48 nt, Artificial Sequence
  Description of Artificial Sequence:  Enzymatic Nucleic Acid
uuuuguauggaggaaacucccuucaaggacaucguccggguacuaaga

SEQ ID NO: 4174 - RNA, 48 nt, Artificial Sequence
  Description of Artificial Sequence:  Enzymatic Nucleic Acid
aaucuuuaggaggaaacucccuucaaggacaucguccggguuguuuug

SEQ ID NO: 4175 - RNA, 48 nt, Artificial Sequence
  Description of Artificial Sequence:  Enzymatic Nucleic Acid
ucuccaauggaggaaacucccuucaaggacaucguccggguuuacuug

SEQ ID NO: 4176 - RNA, 48 nt, Artificial Sequence
  Description of Artificial Sequence:  Enzymatic Nucleic Acid
aaagucucggaggaaacucccuucaaggacaucguccgggaaucuuua

SEQ ID NO: 4177 - RNA, 48 nt, Artificial Sequence
  Description of Artificial Sequence:  Enzymatic Nucleic Acid
caaagucuggaggaaacucccuucaaggacaucguccgggcaaucuuu

SEQ ID NO: 4178 - RNA, 48 nt, Artificial Sequence
  Description of Artificial Sequence:  Enzymatic Nucleic Acid
uccaaaguggaggaaacucccuucaaggacaucguccggguccaaucu

SEQ ID NO: 4179 - RNA, 48 nt, Artificial Sequence
  Description of Artificial Sequence:  Enzymatic Nucleic Acid
uacaagucggaggaaacucccuucaaggacaucguccgggaaagucuc

SEQ ID NO: 4180 - RNA, 48 nt, Artificial Sequence
  Description of Artificial Sequence:  Enzymatic Nucleic Acid
uuacaaguggaggaaacucccuucaaggacaucguccgggcaaagucu

SEQ ID NO: 4181 - RNA, 48 nt, Artificial Sequence
  Description of Artificial Sequence:  Enzymatic Nucleic Acid
agauguuaggaggaaacucccuucaaggacaucguccgggaaguccaa

SEQ ID NO: 4182 - RNA, 48 nt, Artificial Sequence
  Description of Artificial Sequence:  Enzymatic Nucleic Acid
ucauuuuuggaggaaacucccuucaaggacaucguccgggagagaugu

SEQ ID NO: 4183 - RNA, 48 nt, Artificial Sequence
  Description of Artificial Sequence:  Enzymatic Nucleic Acid
cuuuccauggaggaaacucccuucaaggacaucguccgggauuuuuca

SEQ ID NO: 4184 - RNA, 48 nt, Artificial Sequence
  Description of Artificial Sequence:  Enzymatic Nucleic Acid
ucgcuuucggaggaaacucccuucaaggacaucguccgggaucauuuu

SEQ ID NO: 4185 - RNA, 48 nt, Artificial Sequence
  Description of Artificial Sequence:  Enzymatic Nucleic Acid
uucgcuuuggaggaaacucccuucaaggacaucguccgggcaucauuu

SEQ ID NO: 4186 - RNA, 48 nt, Artificial Sequence
  Description of Artificial Sequence:  Enzymatic Nucleic Acid
cuuguucgggaggaaacucccuucaaggacaucguccggguuuccauc

SEQ ID NO: 4187 - RNA, 48 nt, Artificial Sequence
  Description of Artificial Sequence:  Enzymatic Nucleic Acid
uccuuguuggaggaaacucccuucaaggacaucguccggggcuuucca

SEQ ID NO: 4188 - RNA, 48 nt, Artificial Sequence
  Description of Artificial Sequence:  Enzymatic Nucleic Acid
ccuuacucggaggaaacucccuucaaggacaucguccggguuguucgc

SEQ ID NO: 4189 - RNA, 48 nt, Artificial Sequence
  Description of Artificial Sequence:  Enzymatic Nucleic Acid
cccuuacuggaggaaacucccuucaaggacaucguccgggcuuguucg

SEQ ID NO: 4190 - RNA, 48 nt, Artificial Sequence
  Description of Artificial Sequence:  Enzymatic Nucleic Acid
uucccuuaggaggaaacucccuucaaggacaucguccggguccuuguu

SEQ ID NO: 4191 - RNA, 48 nt, Artificial Sequence
  Description of Artificial Sequence:  Enzymatic Nucleic Acid
aaaguuccggaggaaacucccuucaaggacaucguccggguuacuccu

SEQ ID NO: 4192 - RNA, 48 nt, Artificial Sequence
  Description of Artificial Sequence:  Enzymatic Nucleic Acid
caaaguucggaggaaacucccuucaaggacaucguccgggcuuacucc

SEQ ID NO: 4193 - RNA, 48 nt, Artificial Sequence
  Description of Artificial Sequence:  Enzymatic Nucleic Acid
gcaaaguuggaggaaacucccuucaaggacaucguccgggccuuacuc

SEQ ID NO: 4194 - RNA, 48 nt, Artificial Sequence
  Description of Artificial Sequence:  Enzymatic Nucleic Acid
auguaucgggaggaaacucccuucaaggacaucguccgggaaaguucc

SEQ ID NO: 4195 - RNA, 48 nt, Artificial Sequence
  Description of Artificial Sequence:  Enzymatic Nucleic Acid
ucauguauggaggaaacucccuucaaggacaucguccggggcaaaguu

SEQ ID NO: 4196 - RNA, 48 nt, Artificial Sequence
  Description of Artificial Sequence:  Enzymatic Nucleic Acid
ucugggcuggaggaaacucccuucaaggacaucguccgggauguaucg

SEQ ID NO: 4197 - RNA, 48 nt, Artificial Sequence
  Description of Artificial Sequence:  Enzymatic Nucleic Acid
guucugggggaggaaacucccuucaaggacaucguccgggucauguau

SEQ ID NO: 4198 - RNA, 48 nt, Artificial Sequence
  Description of Artificial Sequence:  Enzymatic Nucleic Acid
aaucuguuggaggaaacucccuucaaggacaucguccgggugggcuca

SEQ ID NO: 4199 - RNA, 48 nt, Artificial Sequence
  Description of Artificial Sequence:  Enzymatic Nucleic Acid
gaagaaauggaggaaacucccuucaaggacaucguccggguguucugg

SEQ ID NO: 4200 - RNA, 48 nt, Artificial Sequence
  Description of Artificial Sequence:  Enzymatic Nucleic Acid
uagucuugggaggaaacucccuucaaggacaucguccggggaagaaau

SEQ ID NO: 4201 - RNA, 48 nt, Artificial Sequence
  Description of Artificial Sequence:  Enzymatic Nucleic Acid
uccauaguggaggaaacucccuucaaggacaucguccggguugcgaag

SEQ ID NO: 4202 - RNA, 48 nt, Artificial Sequence
  Description of Artificial Sequence:  Enzymatic Nucleic Acid
uuccuuucggaggaaacucccuucaaggacaucguccgggauagucuu

SEQ ID NO: 4203 - RNA, 48 nt, Artificial Sequence
  Description of Artificial Sequence:  Enzymatic Nucleic Acid
cuuccuuuggaggaaacucccuucaaggacaucguccgggcauagucu

SEQ ID NO: 4204 - RNA, 48 nt, Artificial Sequence
  Description of Artificial Sequence:  Enzymatic Nucleic Acid
uccacuucggaggaaacucccuucaaggacaucguccggguuuccaua

SEQ ID NO: 4205 - RNA, 48 nt, Artificial Sequence
  Description of Artificial Sequence:  Enzymatic Nucleic Acid
guccacuuggaggaaacucccuucaaggacaucguccgggcuuuccau

SEQ ID NO: 4206 - RNA, 48 nt, Artificial Sequence
  Description of Artificial Sequence:  Enzymatic Nucleic Acid
gagguccaggaggaaacucccuucaaggacaucguccggguuccuuuc

SEQ ID NO: 4207 - RNA, 48 nt, Artificial Sequence
  Description of Artificial Sequence:  Enzymatic Nucleic Acid
uagaggucggaggaaacucccuucaaggacaucguccgggacuuccuu

SEQ ID NO: 4208 - RNA, 48 nt, Artificial Sequence
  Description of Artificial Sequence:  Enzymatic Nucleic Acid
guagagguggaggaaacucccuucaaggacaucguccgggcacuuccu

SEQ ID NO: 4209 - RNA, 48 nt, Artificial Sequence
  Description of Artificial Sequence:  Enzymatic Nucleic Acid
ccccaaagggaggaaacucccuucaaggacaucguccgggguagaggu

SEQ ID NO: 4210 - RNA, 48 nt, Artificial Sequence
  Description of Artificial Sequence:  Enzymatic Nucleic Acid
auuagcccggaggaaacucccuucaaggacaucguccgggaaagcgua

SEQ ID NO: 4211 - RNA, 48 nt, Artificial Sequence
  Description of Artificial Sequence:  Enzymatic Nucleic Acid
aauuagccggaggaaacucccuucaaggacaucguccgggcaaagcgu

SEQ ID NO: 4212 - RNA, 48 nt, Artificial Sequence
  Description of Artificial Sequence:  Enzymatic Nucleic Acid
gaauuagcggaggaaacucccuucaaggacaucguccgggccaaagcg

SEQ ID NO: 4213 - RNA, 48 nt, Artificial Sequence
  Description of Artificial Sequence:  Enzymatic Nucleic Acid
agaauuagggaggaaacucccuucaaggacaucguccgggcccaaagc

SEQ ID NO: 4214 - RNA, 48 nt, Artificial Sequence
  Description of Artificial Sequence:  Enzymatic Nucleic Acid
aaguucagggaggaaacucccuucaaggacaucguccgggaagaauua

SEQ ID NO: 4215 - RNA, 48 nt, Artificial Sequence
  Description of Artificial Sequence:  Enzymatic Nucleic Acid
aagaaguuggaggaaacucccuucaaggacaucguccgggagcaagaa

SEQ ID NO: 4216 - RNA, 48 nt, Artificial Sequence
  Description of Artificial Sequence:  Enzymatic Nucleic Acid
gucacauaggaggaaacucccuucaaggacaucguccgggaugaagaa

SEQ ID NO: 4217 - RNA, 48 nt, Artificial Sequence
  Description of Artificial Sequence:  Enzymatic Nucleic Acid
cagugucaggaggaaacucccuucaaggacaucguccgggauacauga

SEQ ID NO: 4218 - RNA, 48 nt, Artificial Sequence
  Description of Artificial Sequence:  Enzymatic Nucleic Acid
agcaguguggaggaaacucccuucaaggacaucguccgggacauacau

SEQ ID NO: 4219 - RNA, 48 nt, Artificial Sequence
  Description of Artificial Sequence:  Enzymatic Nucleic Acid
uucaaaagggaggaaacucccuucaaggacaucguccgggagugucac

SEQ ID NO: 4220 - RNA, 48 nt, Artificial Sequence
  Description of Artificial Sequence:  Enzymatic Nucleic Acid
ugauguuuggaggaaacucccuucaaggacaucguccgggaaaagcag

SEQ ID NO: 4221 - RNA, 48 nt, Artificial Sequence
  Description of Artificial Sequence:  Enzymatic Nucleic Acid
gugaaaaaggaggaaacucccuucaaggacaucguccggguuugaugu

SEQ ID NO: 4222 - RNA, 48 nt, Artificial Sequence
  Description of Artificial Sequence:  Enzymatic Nucleic Acid
ccguagguggaggaaacucccuucaaggacaucguccgggugugaaaa

SEQ ID NO: 4223 - RNA, 48 nt, Artificial Sequence
  Description of Artificial Sequence:  Enzymatic Nucleic Acid
ugccauccggaggaaacucccuucaaggacaucguccgggguaggucu

SEQ ID NO: 4224 - RNA, 48 nt, Artificial Sequence
  Description of Artificial Sequence:  Enzymatic Nucleic Acid
augccaucggaggaaacucccuucaaggacaucguccgggcguagguc

SEQ ID NO: 4225 - RNA, 48 nt, Artificial Sequence
  Description of Artificial Sequence:  Enzymatic Nucleic Acid
gaugccauggaggaaacucccuucaaggacaucguccgggccguaggu

SEQ ID NO: 4226 - RNA, 48 nt, Artificial Sequence
  Description of Artificial Sequence:  Enzymatic Nucleic Acid
gaugaugcggaggaaacucccuucaaggacaucguccgggaucccgua

SEQ ID NO: 4227 - RNA, 48 nt, Artificial Sequence
  Description of Artificial Sequence:  Enzymatic Nucleic Acid
agaugaugggaggaaacucccuucaaggacaucguccgggcaucccgu

SEQ ID NO: 4228 - RNA, 48 nt, Artificial Sequence
  Description of Artificial Sequence:  Enzymatic Nucleic Acid
aaauauauggaggaaacucccuucaaggacaucguccgggugagauga

SEQ ID NO: 4229 - RNA, 48 nt, Artificial Sequence
  Description of Artificial Sequence:  Enzymatic Nucleic Acid
uuuuuuauggaggaaacucccuucaaggacaucguccgggaaauauau

SEQ ID NO: 4230 - RNA, 48 nt, Artificial Sequence
  Description of Artificial Sequence:  Enzymatic Nucleic Acid
aguuuuuuggaggaaacucccuucaaggacaucguccggguuuuuuau

SEQ ID NO: 4231 - RNA, 48 nt, Artificial Sequence
  Description of Artificial Sequence:  Enzymatic Nucleic Acid
aguaauuuggaggaaacucccuucaaggacaucguccggguguagaag

SEQ ID NO: 4232 - RNA, 48 nt, Artificial Sequence
  Description of Artificial Sequence:  Enzymatic Nucleic Acid
ucagguuuggaggaaacucccuucaaggacaucguccggguuugagag

SEQ ID NO: 4233 - RNA, 48 nt, Artificial Sequence
  Description of Artificial Sequence:  Enzymatic Nucleic Acid
ucgauccuggaggaaacucccuucaaggacaucguccgggagguuucu

SEQ ID NO: 4234 - RNA, 48 nt, Artificial Sequence
  Description of Artificial Sequence:  Enzymatic Nucleic Acid
ggucgaucggaggaaacucccuucaaggacaucguccgggucagguuu

SEQ ID NO: 4235 - RNA, 48 nt, Artificial Sequence
  Description of Artificial Sequence:  Enzymatic Nucleic Acid
aggucgauggaggaaacucccuucaaggacaucguccgggcucagguu

SEQ ID NO: 4236 - RNA, 48 nt, Artificial Sequence
  Description of Artificial Sequence:  Enzymatic Nucleic Acid
uguuagguggaggaaacucccuucaaggacaucguccggggauccuca

SEQ ID NO: 4237 - RNA, 48 nt, Artificial Sequence
  Description of Artificial Sequence:  Enzymatic Nucleic Acid
uaguauuuggaggaaacucccuucaaggacaucguccgggagaugugu

SEQ ID NO: 4238 - RNA, 48 nt, Artificial Sequence
  Description of Artificial Sequence:  Enzymatic Nucleic Acid
ucaaggucggaggaaacucccuucaaggacaucguccggguuaguauu

SEQ ID NO: 4239 - RNA, 48 nt, Artificial Sequence
  Description of Artificial Sequence:  Enzymatic Nucleic Acid
gucaagguggaggaaacucccuucaaggacaucguccgggcuuaguau

SEQ ID NO: 4240 - RNA, 48 nt, Artificial Sequence
  Description of Artificial Sequence:  Enzymatic Nucleic Acid
cacacaguggaggaaacucccuucaaggacaucguccgggaagguccu

SEQ ID NO: 4241 - RNA, 48 nt, Artificial Sequence
  Description of Artificial Sequence:  Enzymatic Nucleic Acid
cuuccacaggaggaaacucccuucaaggacaucguccgggagucaagg

SEQ ID NO: 4242 - RNA, 48 nt, Artificial Sequence
  Description of Artificial Sequence:  Enzymatic Nucleic Acid
uucuuccaggaggaaacucccuucaaggacaucguccgggacagucaa

SEQ ID NO: 4243 - RNA, 48 nt, Artificial Sequence
  Description of Artificial Sequence:  Enzymatic Nucleic Acid
uuuucuucggaggaaacucccuucaaggacaucguccgggacacaguc

SEQ ID NO: 4244 - RNA, 48 nt, Artificial Sequence
  Description of Artificial Sequence:  Enzymatic Nucleic Acid
cuuuucuuggaggaaacucccuucaaggacaucguccgggcacacagu

SEQ ID NO: 4245 - RNA, 48 nt, Artificial Sequence
  Description of Artificial Sequence:  Enzymatic Nucleic Acid
gggcuuuuggaggaaacucccuucaaggacaucguccggguuccacac

SEQ ID NO: 4246 - RNA, 48 nt, Artificial Sequence
  Description of Artificial Sequence:  Enzymatic Nucleic Acid
ucucugggggaggaaacucccuucaaggacaucguccggguuuucuuc

SEQ ID NO: 4247 - RNA, 48 nt, Artificial Sequence
  Description of Artificial Sequence:  Enzymatic Nucleic Acid
auuuuucuggaggaaacucccuucaaggacaucguccgggugggcuuu

SEQ ID NO: 4248 - RNA, 48 nt, Artificial Sequence
  Description of Artificial Sequence:  Enzymatic Nucleic Acid
ucauuuuuggaggaaacucccuucaaggacaucguccgggucugggcu

SEQ ID NO: 4249 - RNA, 48 nt, Artificial Sequence
  Description of Artificial Sequence:  Enzymatic Nucleic Acid
gugucguuggaggaaacucccuucaaggacaucguccgggauuuuucu

SEQ ID NO: 4250 - RNA, 48 nt, Artificial Sequence
  Description of Artificial Sequence:  Enzymatic Nucleic Acid
auguguguggaggaaacucccuucaaggacaucguccgggguucauuu

SEQ ID NO: 4251 - RNA, 48 nt, Artificial Sequence
  Description of Artificial Sequence:  Enzymatic Nucleic Acid
ggcucuaaggaggaaacucccuucaaggacaucguccgggaugugugu

SEQ ID NO: 4252 - RNA, 48 nt, Artificial Sequence
  Description of Artificial Sequence:  Enzymatic Nucleic Acid
gaagggcuggaggaaacucccuucaaggacaucguccggguaacaugu

SEQ ID NO: 4253 - RNA, 48 nt, Artificial Sequence
  Description of Artificial Sequence:  Enzymatic Nucleic Acid
cagaagggggaggaaacucccuucaaggacaucguccgggucuaacau

SEQ ID NO: 4254 - RNA, 48 nt, Artificial Sequence
  Description of Artificial Sequence:  Enzymatic Nucleic Acid
uacuuuuuggaggaaacucccuucaaggacaucguccgggagaagggc

SEQ ID NO: 4255 - RNA, 48 nt, Artificial Sequence
  Description of Artificial Sequence:  Enzymatic Nucleic Acid
gcaggauaggaggaaacucccuucaaggacaucguccggguuuuucag

SEQ ID NO: 4256 - RNA, 48 nt, Artificial Sequence
  Description of Artificial Sequence:  Enzymatic Nucleic Acid
aucagaagggaggaaacucccuucaaggacaucguccgggaggauacu

SEQ ID NO: 4257 - RNA, 48 nt, Artificial Sequence
  Description of Artificial Sequence:  Enzymatic Nucleic Acid
cugcauauggaggaaacucccuucaaggacaucguccgggagaagcag

SEQ ID NO: 4258 - RNA, 48 nt, Artificial Sequence
  Description of Artificial Sequence:  Enzymatic Nucleic Acid
gaaaacugggaggaaacucccuucaaggacaucguccgggauaucaga

SEQ ID NO: 4259 - RNA, 48 nt, Artificial Sequence
  Description of Artificial Sequence:  Enzymatic Nucleic Acid
aaggaaaaggaggaaacucccuucaaggacaucguccgggugcauauc

SEQ ID NO: 4260 - RNA, 48 nt, Artificial Sequence
  Description of Artificial Sequence:  Enzymatic Nucleic Acid
uucccuagggaggaaacucccuucaaggacaucguccgggagauuuua

SEQ ID NO: 4261 - RNA, 48 nt, Artificial Sequence
  Description of Artificial Sequence:  Enzymatic Nucleic Acid
gauauuccggaggaaacucccuucaaggacaucguccggguagcagau

SEQ ID NO: 4262 - RNA, 48 nt, Artificial Sequence
  Description of Artificial Sequence:  Enzymatic Nucleic Acid
ugauauucggaggaaacucccuucaaggacaucguccgggcuagcaga

SEQ ID NO: 4263 - RNA, 48 nt, Artificial Sequence
  Description of Artificial Sequence:  Enzymatic Nucleic Acid
uugauauuggaggaaacucccuucaaggacaucguccgggccuagcag

SEQ ID NO: 4264 - RNA, 48 nt, Artificial Sequence
  Description of Artificial Sequence:  Enzymatic Nucleic Acid
guaaauauggaggaaacucccuucaaggacaucguccggguauugaua

SEQ ID NO: 4265 - RNA, 48 nt, Artificial Sequence
  Description of Artificial Sequence:  Enzymatic Nucleic Acid
aaaggaaaggaggaaacucccuucaaggacaucguccgggauuaaaau

SEQ ID NO: 4266 - RNA, 48 nt, Artificial Sequence
  Description of Artificial Sequence:  Enzymatic Nucleic Acid
uguuucugggaggaaacucccuucaaggacaucguccgggagaaagau

SEQ ID NO: 4267 - RNA, 48 nt, Artificial Sequence
  Description of Artificial Sequence:  Enzymatic Nucleic Acid
uucuguuuggaggaaacucccuucaaggacaucguccgggugcagaaa

SEQ ID NO: 4268 - RNA, 48 nt, Artificial Sequence
  Description of Artificial Sequence:  Enzymatic Nucleic Acid
aaaccuuuggaggaaacucccuucaaggacaucguccggguguuucug

SEQ ID NO: 4269 - RNA, 48 nt, Artificial Sequence
  Description of Artificial Sequence:  Enzymatic Nucleic Acid
aagaaaacggaggaaacucccuucaaggacaucguccggguuucuguu

SEQ ID NO: 4270 - RNA, 48 nt, Artificial Sequence
  Description of Artificial Sequence:  Enzymatic Nucleic Acid
gaagaaaaggaggaaacucccuucaaggacaucguccgggcuuucugu

SEQ ID NO: 4271 - RNA, 48 nt, Artificial Sequence
  Description of Artificial Sequence:  Enzymatic Nucleic Acid
uuuugaagggaggaaacucccuucaaggacaucguccgggaaaaagaa

SEQ ID NO: 4272 - RNA, 48 nt, Artificial Sequence
  Description of Artificial Sequence:  Enzymatic Nucleic Acid
agaugagcggaggaaacucccuucaaggacaucguccgggaggaaaaa

SEQ ID NO: 4273 - RNA, 48 nt, Artificial Sequence
  Description of Artificial Sequence:  Enzymatic Nucleic Acid
gagaugagggaggaaacucccuucaaggacaucguccgggcaggaaaa

SEQ ID NO: 4274 - RNA, 48 nt, Artificial Sequence
  Description of Artificial Sequence:  Enzymatic Nucleic Acid
gacucuguggaggaaacucccuucaaggacaucguccggguuuaaaaa

SEQ ID NO: 4275 - RNA, 48 nt, Artificial Sequence
  Description of Artificial Sequence:  Enzymatic Nucleic Acid
gcgagacuggaggaaacucccuucaaggacaucguccgggugucuuua

SEQ ID NO: 4276 - RNA, 48 nt, Artificial Sequence
  Description of Artificial Sequence:  Enzymatic Nucleic Acid
gagcgagaggaggaaacucccuucaaggacaucguccgggucugucuu

SEQ ID NO: 4277 - RNA, 48 nt, Artificial Sequence
  Description of Artificial Sequence:  Enzymatic Nucleic Acid
caacagagggaggaaacucccuucaaggacaucguccggggagacucu

SEQ ID NO: 4278 - RNA, 48 nt, Artificial Sequence
  Description of Artificial Sequence:  Enzymatic Nucleic Acid
cugggcaaggaggaaacucccuucaaggacaucguccgggagagcgag

SEQ ID NO: 4279 - RNA, 48 nt, Artificial Sequence
  Description of Artificial Sequence:  Enzymatic Nucleic Acid
agccugggggaggaaacucccuucaaggacaucguccgggaacagagc

SEQ ID NO: 4280 - RNA, 48 nt, Artificial Sequence
  Description of Artificial Sequence:  Enzymatic Nucleic Acid
acuccagcggaggaaacucccuucaaggacaucguccgggugggcaac

SEQ ID NO: 4281 - RNA, 48 nt, Artificial Sequence
  Description of Artificial Sequence:  Enzymatic Nucleic Acid
cacuccagggaggaaacucccuucaaggacaucguccgggcugggcaa

SEQ ID NO: 4282 - RNA, 48 nt, Artificial Sequence
  Description of Artificial Sequence:  Enzymatic Nucleic Acid
uugcacucggaggaaacucccuucaaggacaucguccgggagccuggg

SEQ ID NO: 4283 - RNA, 48 nt, Artificial Sequence
  Description of Artificial Sequence:  Enzymatic Nucleic Acid
auugcacuggaggaaacucccuucaaggacaucguccgggcagccugg

SEQ ID NO: 4284 - RNA, 48 nt, Artificial Sequence
  Description of Artificial Sequence:  Enzymatic Nucleic Acid
ucauugcaggaggaaacucccuucaaggacaucguccggguccagccu

SEQ ID NO: 4285 - RNA, 48 nt, Artificial Sequence
  Description of Artificial Sequence:  Enzymatic Nucleic Acid
ugucauugggaggaaacucccuucaaggacaucguccgggacuccagc

SEQ ID NO: 4286 - RNA, 48 nt, Artificial Sequence
  Description of Artificial Sequence:  Enzymatic Nucleic Acid
gacuguguggaggaaacucccuucaaggacaucguccgggauugcacu

SEQ ID NO: 4287 - RNA, 48 nt, Artificial Sequence
  Description of Artificial Sequence:  Enzymatic Nucleic Acid
agccaagaggaggaaacucccuucaaggacaucguccgggugugucau

SEQ ID NO: 4288 - RNA, 48 nt, Artificial Sequence
  Description of Artificial Sequence:  Enzymatic Nucleic Acid
cagugagcggaggaaacucccuucaaggacaucguccgggaagacugu

SEQ ID NO: 4289 - RNA, 48 nt, Artificial Sequence
  Description of Artificial Sequence:  Enzymatic Nucleic Acid
gcagugagggaggaaacucccuucaaggacaucguccgggcaagacug

SEQ ID NO: 4290 - RNA, 48 nt, Artificial Sequence
  Description of Artificial Sequence:  Enzymatic Nucleic Acid
agaaguugggaggaaacucccuucaaggacaucguccgggagugagcc

SEQ ID NO: 4291 - RNA, 48 nt, Artificial Sequence
  Description of Artificial Sequence:  Enzymatic Nucleic Acid
ccaagaggggaggaaacucccuucaaggacaucguccgggagaaguug

SEQ ID NO: 4292 - RNA, 48 nt, Artificial Sequence
  Description of Artificial Sequence:  Enzymatic Nucleic Acid
cuugaaccggaggaaacucccuucaaggacaucguccgggaagaggca

SEQ ID NO: 4293 - RNA, 48 nt, Artificial Sequence
  Description of Artificial Sequence:  Enzymatic Nucleic Acid
acuugaacggaggaaacucccuucaaggacaucguccgggcaagaggc

SEQ ID NO: 4294 - RNA, 48 nt, Artificial Sequence
  Description of Artificial Sequence:  Enzymatic Nucleic Acid
cacuugaaggaggaaacucccuucaaggacaucguccgggccaagagg

SEQ ID NO: 4295 - RNA, 48 nt, Artificial Sequence
  Description of Artificial Sequence:  Enzymatic Nucleic Acid
gagaaucaggaggaaacucccuucaaggacaucguccggguugaaccc

SEQ ID NO: 4296 - RNA, 48 nt, Artificial Sequence
  Description of Artificial Sequence:  Enzymatic Nucleic Acid
aggagaauggaggaaacucccuucaaggacaucguccgggacuugaac

SEQ ID NO: 4297 - RNA, 48 nt, Artificial Sequence
  Description of Artificial Sequence:  Enzymatic Nucleic Acid
ggcugaggggaggaaacucccuucaaggacaucguccgggaggagaau

SEQ ID NO: 4298 - RNA, 48 nt, Artificial Sequence
  Description of Artificial Sequence:  Enzymatic Nucleic Acid
ucaggaggggaggaaacucccuucaaggacaucguccgggugaggcag

SEQ ID NO: 4299 - RNA, 48 nt, Artificial Sequence
  Description of Artificial Sequence:  Enzymatic Nucleic Acid
cagcuacuggaggaaacucccuucaaggacaucguccgggaggaggcu

SEQ ID NO: 4300 - RNA, 48 nt, Artificial Sequence
  Description of Artificial Sequence:  Enzymatic Nucleic Acid
uccagcuaggaggaaacucccuucaaggacaucguccgggucaggagg

SEQ ID NO: 4301 - RNA, 48 nt, Artificial Sequence
  Description of Artificial Sequence:  Enzymatic Nucleic Acid
uaauccagggaggaaacucccuucaaggacaucguccggguacucagg

SEQ ID NO: 4302 - RNA, 48 nt, Artificial Sequence
  Description of Artificial Sequence:  Enzymatic Nucleic Acid
cuguaaucggaggaaacucccuucaaggacaucguccgggagcuacuc

SEQ ID NO: 4303 - RNA, 48 nt, Artificial Sequence
  Description of Artificial Sequence:  Enzymatic Nucleic Acid
ccuguaauggaggaaacucccuucaaggacaucguccgggcagcuacu

SEQ ID NO: 4304 - RNA, 48 nt, Artificial Sequence
  Description of Artificial Sequence:  Enzymatic Nucleic Acid
gcacaugcggaggaaacucccuucaaggacaucguccggguguaaucc

SEQ ID NO: 4305 - RNA, 48 nt, Artificial Sequence
  Description of Artificial Sequence:  Enzymatic Nucleic Acid
ggcacaugggaggaaacucccuucaaggacaucguccgggcuguaauc

SEQ ID NO: 4306 - RNA, 48 nt, Artificial Sequence
  Description of Artificial Sequence:  Enzymatic Nucleic Acid
ggguggcaggaggaaacucccuucaaggacaucguccgggaugccugu

SEQ ID NO: 4307 - RNA, 48 nt, Artificial Sequence
  Description of Artificial Sequence:  Enzymatic Nucleic Acid
guggguggggaggaaacucccuucaaggacaucguccgggacaugccu

SEQ ID NO: 4308 - RNA, 48 nt, Artificial Sequence
  Description of Artificial Sequence:  Enzymatic Nucleic Acid
uaaaaacaggaggaaacucccuucaaggacaucguccgggaaaaauua

SEQ ID NO: 4309 - RNA, 48 nt, Artificial Sequence
  Description of Artificial Sequence:  Enzymatic Nucleic Acid
auuaaaaaggaggaaacucccuucaaggacaucguccgggacaaaaau

SEQ ID NO: 4310 - RNA, 48 nt, Artificial Sequence
  Description of Artificial Sequence:  Enzymatic Nucleic Acid
aacccuguggaggaaacucccuucaaggacaucguccggguuuauuaa

SEQ ID NO: 4311 - RNA, 48 nt, Artificial Sequence
  Description of Artificial Sequence:  Enzymatic Nucleic Acid
gugaaaccggaggaaacucccuucaaggacaucguccgggugucuuua

SEQ ID NO: 4312 - RNA, 48 nt, Artificial Sequence
  Description of Artificial Sequence:  Enzymatic Nucleic Acid
ggugaaacggaggaaacucccuucaaggacaucguccgggcugucuuu

SEQ ID NO: 4313 - RNA, 48 nt, Artificial Sequence
  Description of Artificial Sequence:  Enzymatic Nucleic Acid
uggugaaaggaggaaacucccuucaaggacaucguccgggccugucuu

SEQ ID NO: 4314 - RNA, 48 nt, Artificial Sequence
  Description of Artificial Sequence:  Enzymatic Nucleic Acid
cuggccaaggaggaaacucccuucaaggacaucguccgggauggugaa

SEQ ID NO: 4315 - RNA, 48 nt, Artificial Sequence
  Description of Artificial Sequence:  Enzymatic Nucleic Acid
agccuggcggaggaaacucccuucaaggacaucguccgggaacauggu

SEQ ID NO: 4316 - RNA, 48 nt, Artificial Sequence
  Description of Artificial Sequence:  Enzymatic Nucleic Acid
cagccuggggaggaaacucccuucaaggacaucguccgggcaacaugg

SEQ ID NO: 4317 - RNA, 48 nt, Artificial Sequence
  Description of Artificial Sequence:  Enzymatic Nucleic Acid
agaccagcggaggaaacucccuucaaggacaucguccggguggccaac

SEQ ID NO: 4318 - RNA, 48 nt, Artificial Sequence
  Description of Artificial Sequence:  Enzymatic Nucleic Acid
gagaccagggaggaaacucccuucaaggacaucguccgggcuggccaa

SEQ ID NO: 4319 - RNA, 48 nt, Artificial Sequence
  Description of Artificial Sequence:  Enzymatic Nucleic Acid
uuugagacggaggaaacucccuucaaggacaucguccgggagccuggc

SEQ ID NO: 4320 - RNA, 48 nt, Artificial Sequence
  Description of Artificial Sequence:  Enzymatic Nucleic Acid
guuugagaggaggaaacucccuucaaggacaucguccgggcagccugg

SEQ ID NO: 4321 - RNA, 48 nt, Artificial Sequence
  Description of Artificial Sequence:  Enzymatic Nucleic Acid
cuugagguggaggaaacucccuucaaggacaucguccgggaggaguuu

SEQ ID NO: 4322 - RNA, 48 nt, Artificial Sequence
  Description of Artificial Sequence:  Enzymatic Nucleic Acid
guggauuaggaggaaacucccuucaaggacaucguccggguugagguc

SEQ ID NO: 4323 - RNA, 48 nt, Artificial Sequence
  Description of Artificial Sequence:  Enzymatic Nucleic Acid
ggccgaggggaggaaacucccuucaaggacaucguccgggagguggau

SEQ ID NO: 4324 - RNA, 48 nt, Artificial Sequence
  Description of Artificial Sequence:  Enzymatic Nucleic Acid
ugggaggcggaggaaacucccuucaaggacaucguccggggaggcagg

SEQ ID NO: 4325 - RNA, 48 nt, Artificial Sequence
  Description of Artificial Sequence:  Enzymatic Nucleic Acid
uugggaggggaggaaacucccuucaaggacaucguccgggcgaggcag

SEQ ID NO: 4326 - RNA, 48 nt, Artificial Sequence
  Description of Artificial Sequence:  Enzymatic Nucleic Acid
ucccagcaggaggaaacucccuucaaggacaucguccggguuugggag

SEQ ID NO: 4327 - RNA, 48 nt, Artificial Sequence
  Description of Artificial Sequence:  Enzymatic Nucleic Acid
aaucccagggaggaaacucccuucaaggacaucguccgggacuuuggg

SEQ ID NO: 4328 - RNA, 48 nt, Artificial Sequence
  Description of Artificial Sequence:  Enzymatic Nucleic Acid
uguaauccggaggaaacucccuucaaggacaucguccgggagcacuuu

SEQ ID NO: 4329 - RNA, 48 nt, Artificial Sequence
  Description of Artificial Sequence:  Enzymatic Nucleic Acid
cuguaaucggaggaaacucccuucaaggacaucguccgggcagcacuu

SEQ ID NO: 4330 - RNA, 48 nt, Artificial Sequence
  Description of Artificial Sequence:  Enzymatic Nucleic Acid
ccuguaauggaggaaacucccuucaaggacaucguccgggccagcacu

SEQ ID NO: 4331 - RNA, 48 nt, Artificial Sequence
  Description of Artificial Sequence:  Enzymatic Nucleic Acid
gcucauccggaggaaacucccuucaaggacaucguccggguguaaucc

SEQ ID NO: 4332 - RNA, 48 nt, Artificial Sequence
  Description of Artificial Sequence:  Enzymatic Nucleic Acid
ggcucaucggaggaaacucccuucaaggacaucguccgggcuguaauc

SEQ ID NO: 4333 - RNA, 48 nt, Artificial Sequence
  Description of Artificial Sequence:  Enzymatic Nucleic Acid
uggcucauggaggaaacucccuucaaggacaucguccgggccuguaau

SEQ ID NO: 4334 - RNA, 48 nt, Artificial Sequence
  Description of Artificial Sequence:  Enzymatic Nucleic Acid
cgguggcuggaggaaacucccuucaaggacaucguccgggaucccugu

SEQ ID NO: 4335 - RNA, 48 nt, Artificial Sequence
  Description of Artificial Sequence:  Enzymatic Nucleic Acid
cgcgguggggaggaaacucccuucaaggacaucguccgggucaucccu

SEQ ID NO: 4336 - RNA, 48 nt, Artificial Sequence
  Description of Artificial Sequence:  Enzymatic Nucleic Acid
gcugggcgggaggaaacucccuucaaggacaucguccggggguggcuc

SEQ ID NO: 4337 - RNA, 48 nt, Artificial Sequence
  Description of Artificial Sequence:  Enzymatic Nucleic Acid
aggcugggggaggaaacucccuucaaggacaucguccggggcgguggc

SEQ ID NO: 4338 - RNA, 48 nt, Artificial Sequence
  Description of Artificial Sequence:  Enzymatic Nucleic Acid
agaugaggggaggaaacucccuucaaggacaucguccgggugggcgcg

SEQ ID NO: 4339 - RNA, 48 nt, Artificial Sequence
  Description of Artificial Sequence:  Enzymatic Nucleic Acid
cuuuagaaggaggaaacucccuucaaggacaucguccgggaaagagau

SEQ ID NO: 4340 - RNA, 48 nt, Artificial Sequence
  Description of Artificial Sequence:  Enzymatic Nucleic Acid
uuuuccauggaggaaacucccuucaaggacaucguccggguuuagaac

SEQ ID NO: 4341 - RNA, 48 nt, Artificial Sequence
  Description of Artificial Sequence:  Enzymatic Nucleic Acid
gguuuuucggaggaaacucccuucaaggacaucguccgggaucuuuag

SEQ ID NO: 4342 - RNA, 48 nt, Artificial Sequence
  Description of Artificial Sequence:  Enzymatic Nucleic Acid
ugguuuuuggaggaaacucccuucaaggacaucguccgggcaucuuua

SEQ ID NO: 4343 - RNA, 48 nt, Artificial Sequence
  Description of Artificial Sequence:  Enzymatic Nucleic Acid
gauugauuggaggaaacucccuucaaggacaucguccgggauuaauag

SEQ ID NO: 4344 - RNA, 48 nt, Artificial Sequence
  Description of Artificial Sequence:  Enzymatic Nucleic Acid
ccuaaaagggaggaaacucccuucaaggacaucguccggggguagaaa

SEQ ID NO: 4345 - RNA, 48 nt, Artificial Sequence
  Description of Artificial Sequence:  Enzymatic Nucleic Acid
uuuuuggcggaggaaacucccuucaaggacaucguccggguaaaagcg

SEQ ID NO: 4346 - RNA, 48 nt, Artificial Sequence
  Description of Artificial Sequence:  Enzymatic Nucleic Acid
uuuuuuggggaggaaacucccuucaaggacaucguccgggcuaaaagc

SEQ ID NO: 4347 - RNA, 48 nt, Artificial Sequence
  Description of Artificial Sequence:  Enzymatic Nucleic Acid
cgaucuuaggaggaaacucccuucaaggacaucguccgggauuuuuuu

SEQ ID NO: 4348 - RNA, 48 nt, Artificial Sequence
  Description of Artificial Sequence:  Enzymatic Nucleic Acid
agaacgauggaggaaacucccuucaaggacaucguccggguuacauuu

SEQ ID NO: 4349 - RNA, 48 nt, Artificial Sequence
  Description of Artificial Sequence:  Enzymatic Nucleic Acid
gcagagaaggaggaaacucccuucaaggacaucguccggggaucuuac

SEQ ID NO: 4350 - RNA, 48 nt, Artificial Sequence
  Description of Artificial Sequence:  Enzymatic Nucleic Acid
augugaggggaggaaacucccuucaaggacaucguccgggagagaacg

SEQ ID NO: 4351 - RNA, 48 nt, Artificial Sequence
  Description of Artificial Sequence:  Enzymatic Nucleic Acid
cuuguaagggaggaaacucccuucaaggacaucguccggguaugugag

SEQ ID NO: 4352 - RNA, 48 nt, Artificial Sequence
  Description of Artificial Sequence:  Enzymatic Nucleic Acid
ccagcuggggaggaaacucccuucaaggacaucguccggguuguaagc

SEQ ID NO: 4353 - RNA, 48 nt, Artificial Sequence
  Description of Artificial Sequence:  Enzymatic Nucleic Acid
uucuccagggaggaaacucccuucaaggacaucguccggguggcuugu

SEQ ID NO: 4354 - RNA, 48 nt, Artificial Sequence
  Description of Artificial Sequence:  Enzymatic Nucleic Acid
uauuucucggaggaaacucccuucaaggacaucguccgggagcuggcu

SEQ ID NO: 4355 - RNA, 48 nt, Artificial Sequence
  Description of Artificial Sequence:  Enzymatic Nucleic Acid
auauuucuggaggaaacucccuucaaggacaucguccgggcagcuggc

SEQ ID NO: 4356 - RNA, 48 nt, Artificial Sequence
  Description of Artificial Sequence:  Enzymatic Nucleic Acid
ccauauuuggaggaaacucccuucaaggacaucguccggguccagcug

SEQ ID NO: 4357 - RNA, 48 nt, Artificial Sequence
  Description of Artificial Sequence:  Enzymatic Nucleic Acid
augaguacggaggaaacucccuucaaggacaucguccgggauauuucu

SEQ ID NO: 4358 - RNA, 48 nt, Artificial Sequence
  Description of Artificial Sequence:  Enzymatic Nucleic Acid
aaugaguaggaggaaacucccuucaaggacaucguccgggcauauuuc

SEQ ID NO: 4359 - RNA, 48 nt, Artificial Sequence
  Description of Artificial Sequence:  Enzymatic Nucleic Acid
guacaucaggaggaaacucccuucaaggacaucguccggguuuuuuuu

SEQ ID NO: 4360 - RNA, 48 nt, Artificial Sequence
  Description of Artificial Sequence:  Enzymatic Nucleic Acid
uuguacauggaggaaacucccuucaaggacaucguccgggacuuuuuu

SEQ ID NO: 4361 - RNA, 17 nt, Homo sapiens
auggcccuugugaucca

SEQ ID NO: 4362 - RNA, 17 nt, Homo sapiens
cuugugauccagguggg

SEQ ID NO: 4363 - RNA, 17 nt, Homo sapiens
gggaaacuaaggcccag

SEQ ID NO: 4364 - RNA, 17 nt, Homo sapiens
cgcagacuaucaauccc

SEQ ID NO: 4365 - RNA, 17 nt, Homo sapiens
cagacuaucaaucccag

SEQ ID NO: 4366 - RNA, 17 nt, Homo sapiens
cuaucaaucccagucuc

SEQ ID NO: 4367 - RNA, 17 nt, Homo sapiens
aucccagucucuucccc

SEQ ID NO: 4368 - RNA, 17 nt, Homo sapiens
cccagucucuuccccuc

SEQ ID NO: 4369 - RNA, 17 nt, Homo sapiens
cagucucuuccccucac

SEQ ID NO: 4370 - RNA, 17 nt, Homo sapiens
agucucuuccccucacu

SEQ ID NO: 4371 - RNA, 17 nt, Homo sapiens
cuuccccucacucccug

SEQ ID NO: 4372 - RNA, 17 nt, Homo sapiens
cccucacucccugugaa

SEQ ID NO: 4373 - RNA, 17 nt, Homo sapiens
gugaagcucuccagcau

SEQ ID NO: 4374 - RNA, 17 nt, Homo sapiens
gaagcucuccagcauca

SEQ ID NO: 4375 - RNA, 17 nt, Homo sapiens
uccagcaucaucgaggu

SEQ ID NO: 4376 - RNA, 17 nt, Homo sapiens
agcaucaucgagguccc

SEQ ID NO: 4377 - RNA, 17 nt, Homo sapiens
aucgaggucccaucagc

SEQ ID NO: 4378 - RNA, 17 nt, Homo sapiens
ggucccaucagcccuug

SEQ ID NO: 4379 - RNA, 17 nt, Homo sapiens
ucagcccuugcccuguu

SEQ ID NO: 4380 - RNA, 17 nt, Homo sapiens
ugcccuguuggaugaau

SEQ ID NO: 4381 - RNA, 17 nt, Homo sapiens
ggaugaauaggcaccuc

SEQ ID NO: 4382 - RNA, 17 nt, Homo sapiens
aggcaccucuggaagag

SEQ ID NO: 4383 - RNA, 17 nt, Homo sapiens
cagcagaucaggacgua

SEQ ID NO: 4384 - RNA, 17 nt, Homo sapiens
caggacguacugggcga

SEQ ID NO: 4385 - RNA, 17 nt, Homo sapiens
cgaagagucuccucugg

SEQ ID NO: 4386 - RNA, 17 nt, Homo sapiens
aagagucuccucugggg

SEQ ID NO: 4387 - RNA, 17 nt, Homo sapiens
agucuccucuggggaag

SEQ ID NO: 4388 - RNA, 17 nt, Homo sapiens
accugccuucagaacag

SEQ ID NO: 4389 - RNA, 17 nt, Homo sapiens
ccugccuucagaacagg

SEQ ID NO: 4390 - RNA, 17 nt, Homo sapiens
agggcgcuccugagacc

SEQ ID NO: 4391 - RNA, 17 nt, Homo sapiens
gagacccuccagcgcug

SEQ ID NO: 4392 - RNA, 17 nt, Homo sapiens
aggagaaucaagagcuc

SEQ ID NO: 4393 - RNA, 17 nt, Homo sapiens
caagagcuccgagaugc

SEQ ID NO: 4394 - RNA, 17 nt, Homo sapiens
gaugccauccggcagag

SEQ ID NO: 4395 - RNA, 17 nt, Homo sapiens
aaccagauucugcggga

SEQ ID NO: 4396 - RNA, 17 nt, Homo sapiens
accagauucugcgggag

SEQ ID NO: 4397 - RNA, 17 nt, Homo sapiens
gaggagcuucugcauuu

SEQ ID NO: 4398 - RNA, 17 nt, Homo sapiens
aggagcuucugcauuuc

SEQ ID NO: 4399 - RNA, 17 nt, Homo sapiens
uucugcauuuccaagcc

SEQ ID NO: 4400 - RNA, 17 nt, Homo sapiens
ucugcauuuccaagcca

SEQ ID NO: 4401 - RNA, 17 nt, Homo sapiens
cugcauuuccaagccag

SEQ ID NO: 4402 - RNA, 17 nt, Homo sapiens
gaaggaguuccucaugu

SEQ ID NO: 4403 - RNA, 17 nt, Homo sapiens
aaggaguuccucaugug

SEQ ID NO: 4404 - RNA, 17 nt, Homo sapiens
gaguuccucaugugcaa

SEQ ID NO: 4405 - RNA, 17 nt, Homo sapiens
gugcaaguuccaggagg

SEQ ID NO: 4406 - RNA, 17 nt, Homo sapiens
ugcaaguuccaggaggc

SEQ ID NO: 4407 - RNA, 17 nt, Homo sapiens
gagagacucggccugga

SEQ ID NO: 4408 - RNA, 17 nt, Homo sapiens
gagaagcucgaucugaa

SEQ ID NO: 4409 - RNA, 17 nt, Homo sapiens
agcucgaucugaagagg

SEQ ID NO: 4410 - RNA, 17 nt, Homo sapiens
agcaggcucugcgggag

SEQ ID NO: 4411 - RNA, 17 nt, Homo sapiens
caaggccucugugaaag

SEQ ID NO: 4412 - RNA, 17 nt, Homo sapiens
ggugacguccuugcucg

SEQ ID NO: 4413 - RNA, 17 nt, Homo sapiens
gacguccuugcucgggg

SEQ ID NO: 4414 - RNA, 17 nt, Homo sapiens
uccuugcucggggagcu

SEQ ID NO: 4415 - RNA, 17 nt, Homo sapiens
gccagagucgcuuggag

SEQ ID NO: 4416 - RNA, 17 nt, Homo sapiens
gagucgcuuggaggcug

SEQ ID NO: 4417 - RNA, 17 nt, Homo sapiens
cugccacuaaggaaugc

SEQ ID NO: 4418 - RNA, 17 nt, Homo sapiens
gccaggcucuggagggu

SEQ ID NO: 4419 - RNA, 17 nt, Homo sapiens
uggagggucgggcccgg

SEQ ID NO: 4420 - RNA, 17 nt, Homo sapiens
gccgcgcuccgcaugga

SEQ ID NO: 4421 - RNA, 17 nt, Homo sapiens
ggccgccucggaggaga

SEQ ID NO: 4422 - RNA, 17 nt, Homo sapiens
ggcccaguugcaggugg

SEQ ID NO: 4423 - RNA, 17 nt, Homo sapiens
gguggccuaucaccagc

SEQ ID NO: 4424 - RNA, 17 nt, Homo sapiens
uggccuaucaccagcuc

SEQ ID NO: 4425 - RNA, 17 nt, Homo sapiens
caccagcucuuccaaga

SEQ ID NO: 4426 - RNA, 17 nt, Homo sapiens
ccagcucuuccaagaau

SEQ ID NO: 4427 - RNA, 17 nt, Homo sapiens
cagcucuuccaagaaua

SEQ ID NO: 4428 - RNA, 17 nt, Homo sapiens
ccaagaauacgacaacc

SEQ ID NO: 4429 - RNA, 17 nt, Homo sapiens
aaccacaucaagagcag

SEQ ID NO: 4430 - RNA, 17 nt, Homo sapiens
uggaagaucucaaacag

SEQ ID NO: 4431 - RNA, 17 nt, Homo sapiens
gaagaucucaaacagca

SEQ ID NO: 4432 - RNA, 17 nt, Homo sapiens
cagcagcuccagcaggc

SEQ ID NO: 4433 - RNA, 17 nt, Homo sapiens
gaggugaucgauaagcu

SEQ ID NO: 4434 - RNA, 17 nt, Homo sapiens
ugaucgauaagcugaag

SEQ ID NO: 4435 - RNA, 17 nt, Homo sapiens
cacaagauugugaugga

SEQ ID NO: 4436 - RNA, 17 nt, Homo sapiens
gagaccguuccggugcu

SEQ ID NO: 4437 - RNA, 17 nt, Homo sapiens
agaccguuccggugcug

SEQ ID NO: 4438 - RNA, 17 nt, Homo sapiens
aggcggauaucuacaag

SEQ ID NO: 4439 - RNA, 17 nt, Homo sapiens
gcggauaucuacaaggc

SEQ ID NO: 4440 - RNA, 17 nt, Homo sapiens
ggauaucuacaaggcgg

SEQ ID NO: 4441 - RNA, 17 nt, Homo sapiens
ggcggacuuccaggcug

SEQ ID NO: 4442 - RNA, 17 nt, Homo sapiens
gcggacuuccaggcuga

SEQ ID NO: 4443 - RNA, 17 nt, Homo sapiens
aaggagcuccugcagga

SEQ ID NO: 4444 - RNA, 17 nt, Homo sapiens
gagggaguacagcaaac

SEQ ID NO: 4445 - RNA, 17 nt, Homo sapiens
ccagcugucaggagucg

SEQ ID NO: 4446 - RNA, 17 nt, Homo sapiens
ucaggagucggccagga

SEQ ID NO: 4447 - RNA, 17 nt, Homo sapiens
gccaggaucgaggacau

SEQ ID NO: 4448 - RNA, 17 nt, Homo sapiens
cggcaugucgaggucuc

SEQ ID NO: 4449 - RNA, 17 nt, Homo sapiens
gucgaggucucccaggc

SEQ ID NO: 4450 - RNA, 17 nt, Homo sapiens
cgaggucucccaggccc

SEQ ID NO: 4451 - RNA, 17 nt, Homo sapiens
ggcccccuugccccccg

SEQ ID NO: 4452 - RNA, 17 nt, Homo sapiens
cccugccuaccucuccu

SEQ ID NO: 4453 - RNA, 17 nt, Homo sapiens
gccuaccucuccucucc

SEQ ID NO: 4454 - RNA, 17 nt, Homo sapiens
cuaccucuccucucccc

SEQ ID NO: 4455 - RNA, 17 nt, Homo sapiens
ccucuccucuccccugg

SEQ ID NO: 4456 - RNA, 17 nt, Homo sapiens
ucuccucuccccuggcc

SEQ ID NO: 4457 - RNA, 17 nt, Homo sapiens
accugacuucugcuguc

SEQ ID NO: 4458 - RNA, 17 nt, Homo sapiens
ccugacuucugcugucc

SEQ ID NO: 4459 - RNA, 17 nt, Homo sapiens
ucugcugucccaagugc

SEQ ID NO: 4460 - RNA, 17 nt, Homo sapiens
gugccaguaucaggccc

SEQ ID NO: 4461 - RNA, 17 nt, Homo sapiens
gccaguaucaggccccu

SEQ ID NO: 4462 - RNA, 17 nt, Homo sapiens
ccccugauauggacacc

SEQ ID NO: 4463 - RNA, 17 nt, Homo sapiens
cugcagauacaugucau

SEQ ID NO: 4464 - RNA, 17 nt, Homo sapiens
auacaugucauggagug

SEQ ID NO: 4465 - RNA, 17 nt, Homo sapiens
gagugcauugaguaggg

SEQ ID NO: 4466 - RNA, 17 nt, Homo sapiens
cauugaguagggccggc

SEQ ID NO: 4467 - RNA, 17 nt, Homo sapiens
cgugcagucugcgcuuu

SEQ ID NO: 4468 - RNA, 17 nt, Homo sapiens
ucugcgcuuuccucucc

SEQ ID NO: 4469 - RNA, 17 nt, Homo sapiens
cugcgcuuuccucuccc

SEQ ID NO: 4470 - RNA, 17 nt, Homo sapiens
ugcgcuuuccucucccg

SEQ ID NO: 4471 - RNA, 17 nt, Homo sapiens
gcuuuccucucccgccu

SEQ ID NO: 4472 - RNA, 17 nt, Homo sapiens
uuuccucucccgccugc

SEQ ID NO: 4473 - RNA, 17 nt, Homo sapiens
gccugccuagcccagga

SEQ ID NO: 4474 - RNA, 17 nt, Homo sapiens
cggcaccuuacgcuuca

SEQ ID NO: 4475 - RNA, 17 nt, Homo sapiens
ggcaccuuacgcuucag

SEQ ID NO: 4476 - RNA, 17 nt, Homo sapiens
cuuacgcuucagcuguu

SEQ ID NO: 4477 - RNA, 17 nt, Homo sapiens
uuacgcuucagcuguug

SEQ ID NO: 4478 - RNA, 17 nt, Homo sapiens
ucagcuguugauccgcu

SEQ ID NO: 4479 - RNA, 17 nt, Homo sapiens
cuguugauccgcugguc

SEQ ID NO: 4480 - RNA, 17 nt, Homo sapiens
ccgcugguccccucuuu

SEQ ID NO: 4481 - RNA, 17 nt, Homo sapiens
gguccccucuuuugggg

SEQ ID NO: 4482 - RNA, 17 nt, Homo sapiens
uccccucuuuuggggua

SEQ ID NO: 4483 - RNA, 17 nt, Homo sapiens
ccccucuuuugggguag

SEQ ID NO: 4484 - RNA, 17 nt, Homo sapiens
cccucuuuugggguaga

SEQ ID NO: 4485 - RNA, 17 nt, Homo sapiens
uuugggguagaugcggc

SEQ ID NO: 4486 - RNA, 17 nt, Homo sapiens
gccccgaucaggccuga

SEQ ID NO: 4487 - RNA, 17 nt, Homo sapiens
gccugacucgcugcucu

SEQ ID NO: 4488 - RNA, 17 nt, Homo sapiens
ucgcugcucuuuuuguu

SEQ ID NO: 4489 - RNA, 17 nt, Homo sapiens
gcugcucuuuuuguucc

SEQ ID NO: 4490 - RNA, 17 nt, Homo sapiens
cugcucuuuuuguuccc

SEQ ID NO: 4491 - RNA, 17 nt, Homo sapiens
ugcucuuuuuguucccu

SEQ ID NO: 4492 - RNA, 17 nt, Homo sapiens
gcucuuuuuguucccuu

SEQ ID NO: 4493 - RNA, 17 nt, Homo sapiens
cuuuuuguucccuucug

SEQ ID NO: 4494 - RNA, 17 nt, Homo sapiens
uuuuuguucccuucugu

SEQ ID NO: 4495 - RNA, 17 nt, Homo sapiens
uguucccuucugucugc

SEQ ID NO: 4496 - RNA, 17 nt, Homo sapiens
guucccuucugucugcu

SEQ ID NO: 4497 - RNA, 17 nt, Homo sapiens
ccuucugucugcucgaa

SEQ ID NO: 4498 - RNA, 17 nt, Homo sapiens
ugucugcucgaaccacu

SEQ ID NO: 4499 - RNA, 17 nt, Homo sapiens
gaaccacuugccucggg

SEQ ID NO: 4500 - RNA, 17 nt, Homo sapiens
acuugccucgggcuaau

SEQ ID NO: 4501 - RNA, 17 nt, Homo sapiens
cucgggcuaaucccucc

SEQ ID NO: 4502 - RNA, 17 nt, Homo sapiens
gggcuaaucccucccuc

SEQ ID NO: 4503 - RNA, 17 nt, Homo sapiens
uaaucccucccucuucc

SEQ ID NO: 4504 - RNA, 17 nt, Homo sapiens
cccucccucuuccucca

SEQ ID NO: 4505 - RNA, 17 nt, Homo sapiens
cucccucuuccuccacc

SEQ ID NO: 4506 - RNA, 17 nt, Homo sapiens
ucccucuuccuccaccc

SEQ ID NO: 4507 - RNA, 17 nt, Homo sapiens
cucuuccuccacccggc

SEQ ID NO: 4508 - RNA, 17 nt, Homo sapiens
ggggaagucaagaaugg

SEQ ID NO: 4509 - RNA, 17 nt, Homo sapiens
cuggggcucucagggag

SEQ ID NO: 4510 - RNA, 17 nt, Homo sapiens
ggggcucucagggagaa

SEQ ID NO: 4511 - RNA, 17 nt, Homo sapiens
gaacugcuuccccuggc

SEQ ID NO: 4512 - RNA, 17 nt, Homo sapiens
aacugcuuccccuggca

SEQ ID NO: 4513 - RNA, 17 nt, Homo sapiens
uggcagcucuuccuccc

SEQ ID NO: 4514 - RNA, 17 nt, Homo sapiens
gcagcucuuccucccac

SEQ ID NO: 4515 - RNA, 17 nt, Homo sapiens
cagcucuuccucccacc

SEQ ID NO: 4516 - RNA, 17 nt, Homo sapiens
cucuuccucccaccgga

SEQ ID NO: 4517 - RNA, 17 nt, Homo sapiens
gcugcccucuuaccaug

SEQ ID NO: 4518 - RNA, 17 nt, Homo sapiens
ugcccucuuaccaugca

SEQ ID NO: 4519 - RNA, 17 nt, Homo sapiens
gcccucuuaccaugcac

SEQ ID NO: 4520 - RNA, 17 nt, Homo sapiens
cgggugcucuccuuuug

SEQ ID NO: 4521 - RNA, 17 nt, Homo sapiens
ggugcucuccuuuuggg

SEQ ID NO: 4522 - RNA, 17 nt, Homo sapiens
gcucuccuuuugggcug

SEQ ID NO: 4523 - RNA, 17 nt, Homo sapiens
cucuccuuuugggcugc

SEQ ID NO: 4524 - RNA, 17 nt, Homo sapiens
ucuccuuuugggcugca

SEQ ID NO: 4525 - RNA, 17 nt, Homo sapiens
ugcaugcuauuccauuu

SEQ ID NO: 4526 - RNA, 17 nt, Homo sapiens
caugcuauuccauuuug

SEQ ID NO: 4527 - RNA, 17 nt, Homo sapiens
augcuauuccauuuugc

SEQ ID NO: 4528 - RNA, 17 nt, Homo sapiens
uauuccauuuugcagcc

SEQ ID NO: 4529 - RNA, 17 nt, Homo sapiens
auuccauuuugcagcca

SEQ ID NO: 4530 - RNA, 17 nt, Homo sapiens
uuccauuuugcagccag

SEQ ID NO: 4531 - RNA, 17 nt, Homo sapiens
cgauguguauuuaacca

SEQ ID NO: 4532 - RNA, 17 nt, Homo sapiens
auguguauuuaaccagu

SEQ ID NO: 4533 - RNA, 17 nt, Homo sapiens
uguguauuuaaccaguc

SEQ ID NO: 4534 - RNA, 17 nt, Homo sapiens
guguauuuaaccaguca

SEQ ID NO: 4535 - RNA, 17 nt, Homo sapiens
uaaccagucacuauuga

SEQ ID NO: 4536 - RNA, 17 nt, Homo sapiens
cagucacuauugaugga

SEQ ID NO: 4537 - RNA, 17 nt, Homo sapiens
gucacuauugauggaca

SEQ ID NO: 4538 - RNA, 17 nt, Homo sapiens
auggacauuuggguugu

SEQ ID NO: 4539 - RNA, 17 nt, Homo sapiens
uggacauuuggguuguu

SEQ ID NO: 4540 - RNA, 17 nt, Homo sapiens
auuuggguuguuuccca

SEQ ID NO: 4541 - RNA, 17 nt, Homo sapiens
uggguuguuucccaucu

SEQ ID NO: 4542 - RNA, 17 nt, Homo sapiens
ggguuguuucccaucuu

SEQ ID NO: 4543 - RNA, 17 nt, Homo sapiens
gguuguuucccaucuuu

SEQ ID NO: 4544 - RNA, 17 nt, Homo sapiens
uuucccaucuuuuuguu

SEQ ID NO: 4545 - RNA, 17 nt, Homo sapiens
ucccaucuuuuuguuac

SEQ ID NO: 4546 - RNA, 17 nt, Homo sapiens
cccaucuuuuuguuacc

SEQ ID NO: 4547 - RNA, 17 nt, Homo sapiens
ccaucuuuuuguuacca

SEQ ID NO: 4548 - RNA, 17 nt, Homo sapiens
caucuuuuuguuaccau

SEQ ID NO: 4549 - RNA, 17 nt, Homo sapiens
cuuuuuguuaccauaaa

SEQ ID NO: 4550 - RNA, 17 nt, Homo sapiens
uuuuuguuaccauaaau

SEQ ID NO: 4551 - RNA, 17 nt, Homo sapiens
guuaccauaaauaaugg

SEQ ID NO: 4552 - RNA, 17 nt, Homo sapiens
ccauaaauaauggcaua

SEQ ID NO: 4553 - RNA, 17 nt, Homo sapiens
aauggcauaguaaaaaa

SEQ ID NO: 4554 - RNA, 17 nt, Homo sapiens
ggcauaguaaaaaaaaa

SEQ ID NO: 4555 - RNA, 38 nt, Artificial Sequence
  Description of Artificial Sequence:  Enzymatic Nucleic Acid
uggaucaccugaugaggccguuaggccgaaagggccau

SEQ ID NO: 4556 - RNA, 38 nt, Artificial Sequence
  Description of Artificial Sequence:  Enzymatic Nucleic Acid
cccaccugcugaugaggccguuaggccgaaaucacaag

SEQ ID NO: 4557 - RNA, 38 nt, Artificial Sequence
  Description of Artificial Sequence:  Enzymatic Nucleic Acid
cugggccucugaugaggccguuaggccgaaaguuuccc

SEQ ID NO: 4558 - RNA, 38 nt, Artificial Sequence
  Description of Artificial Sequence:  Enzymatic Nucleic Acid
gggauugacugaugaggccguuaggccgaaagucugcg

SEQ ID NO: 4559 - RNA, 38 nt, Artificial Sequence
  Description of Artificial Sequence:  Enzymatic Nucleic Acid
cugggauucugaugaggccguuaggccgaaauagucug

SEQ ID NO: 4560 - RNA, 38 nt, Artificial Sequence
  Description of Artificial Sequence:  Enzymatic Nucleic Acid
gagacuggcugaugaggccguuaggccgaaauugauag

SEQ ID NO: 4561 - RNA, 38 nt, Artificial Sequence
  Description of Artificial Sequence:  Enzymatic Nucleic Acid
ggggaagacugaugaggccguuaggccgaaacugggau

SEQ ID NO: 4562 - RNA, 38 nt, Artificial Sequence
  Description of Artificial Sequence:  Enzymatic Nucleic Acid
gaggggaacugaugaggccguuaggccgaaagacuggg

SEQ ID NO: 4563 - RNA, 38 nt, Artificial Sequence
  Description of Artificial Sequence:  Enzymatic Nucleic Acid
gugaggggcugaugaggccguuaggccgaaagagacug

SEQ ID NO: 4564 - RNA, 38 nt, Artificial Sequence
  Description of Artificial Sequence:  Enzymatic Nucleic Acid
agugagggcugaugaggccguuaggccgaaaagagacu

SEQ ID NO: 4565 - RNA, 38 nt, Artificial Sequence
  Description of Artificial Sequence:  Enzymatic Nucleic Acid
cagggagucugaugaggccguuaggccgaaaggggaag

SEQ ID NO: 4566 - RNA, 38 nt, Artificial Sequence
  Description of Artificial Sequence:  Enzymatic Nucleic Acid
uucacaggcugaugaggccguuaggccgaaagugaggg

SEQ ID NO: 4567 - RNA, 38 nt, Artificial Sequence
  Description of Artificial Sequence:  Enzymatic Nucleic Acid
augcuggacugaugaggccguuaggccgaaagcuucac

SEQ ID NO: 4568 - RNA, 38 nt, Artificial Sequence
  Description of Artificial Sequence:  Enzymatic Nucleic Acid
ugaugcugcugaugaggccguuaggccgaaagagcuuc

SEQ ID NO: 4569 - RNA, 38 nt, Artificial Sequence
  Description of Artificial Sequence:  Enzymatic Nucleic Acid
accucgaucugaugaggccguuaggccgaaaugcugga

SEQ ID NO: 4570 - RNA, 38 nt, Artificial Sequence
  Description of Artificial Sequence:  Enzymatic Nucleic Acid
gggaccuccugaugaggccguuaggccgaaaugaugcu

SEQ ID NO: 4571 - RNA, 38 nt, Artificial Sequence
  Description of Artificial Sequence:  Enzymatic Nucleic Acid
gcugauggcugaugaggccguuaggccgaaaccucgau

SEQ ID NO: 4572 - RNA, 38 nt, Artificial Sequence
  Description of Artificial Sequence:  Enzymatic Nucleic Acid
caagggcucugaugaggccguuaggccgaaaugggacc

SEQ ID NO: 4573 - RNA, 38 nt, Artificial Sequence
  Description of Artificial Sequence:  Enzymatic Nucleic Acid
aacagggccugaugaggccguuaggccgaaagggcuga

SEQ ID NO: 4574 - RNA, 38 nt, Artificial Sequence
  Description of Artificial Sequence:  Enzymatic Nucleic Acid
auucaucccugaugaggccguuaggccgaaacagggca

SEQ ID NO: 4575 - RNA, 38 nt, Artificial Sequence
  Description of Artificial Sequence:  Enzymatic Nucleic Acid
gaggugcccugaugaggccguuaggccgaaauucaucc

SEQ ID NO: 4576 - RNA, 38 nt, Artificial Sequence
  Description of Artificial Sequence:  Enzymatic Nucleic Acid
cucuuccacugaugaggccguuaggccgaaaggugccu

SEQ ID NO: 4577 - RNA, 38 nt, Artificial Sequence
  Description of Artificial Sequence:  Enzymatic Nucleic Acid
uacguccucugaugaggccguuaggccgaaaucugcug

SEQ ID NO: 4578 - RNA, 38 nt, Artificial Sequence
  Description of Artificial Sequence:  Enzymatic Nucleic Acid
ucgcccagcugaugaggccguuaggccgaaacguccug

SEQ ID NO: 4579 - RNA, 38 nt, Artificial Sequence
  Description of Artificial Sequence:  Enzymatic Nucleic Acid
ccagaggacugaugaggccguuaggccgaaacucuucg

SEQ ID NO: 4580 - RNA, 38 nt, Artificial Sequence
  Description of Artificial Sequence:  Enzymatic Nucleic Acid
ccccagagcugaugaggccguuaggccgaaagacucuu

SEQ ID NO: 4581 - RNA, 38 nt, Artificial Sequence
  Description of Artificial Sequence:  Enzymatic Nucleic Acid
cuuccccacugaugaggccguuaggccgaaaggagacu

SEQ ID NO: 4582 - RNA, 38 nt, Artificial Sequence
  Description of Artificial Sequence:  Enzymatic Nucleic Acid
cuguucugcugaugaggccguuaggccgaaaggcaggu

SEQ ID NO: 4583 - RNA, 38 nt, Artificial Sequence
  Description of Artificial Sequence:  Enzymatic Nucleic Acid
ccuguucucugaugaggccguuaggccgaaaaggcagg

SEQ ID NO: 4584 - RNA, 38 nt, Artificial Sequence
  Description of Artificial Sequence:  Enzymatic Nucleic Acid
ggucucagcugaugaggccguuaggccgaaagcgcccu

SEQ ID NO: 4585 - RNA, 38 nt, Artificial Sequence
  Description of Artificial Sequence:  Enzymatic Nucleic Acid
cagcgcugcugaugaggccguuaggccgaaagggucuc

SEQ ID NO: 4586 - RNA, 38 nt, Artificial Sequence
  Description of Artificial Sequence:  Enzymatic Nucleic Acid
gagcucuucugaugaggccguuaggccgaaauucuccu

SEQ ID NO: 4587 - RNA, 38 nt, Artificial Sequence
  Description of Artificial Sequence:  Enzymatic Nucleic Acid
gcaucucgcugaugaggccguuaggccgaaagcucuug

SEQ ID NO: 4588 - RNA, 38 nt, Artificial Sequence
  Description of Artificial Sequence:  Enzymatic Nucleic Acid
cucugccgcugaugaggccguuaggccgaaauggcauc

SEQ ID NO: 4589 - RNA, 38 nt, Artificial Sequence
  Description of Artificial Sequence:  Enzymatic Nucleic Acid
ucccgcagcugaugaggccguuaggccgaaaucugguu

SEQ ID NO: 4590 - RNA, 38 nt, Artificial Sequence
  Description of Artificial Sequence:  Enzymatic Nucleic Acid
cucccgcacugaugaggccguuaggccgaaaaucuggu

SEQ ID NO: 4591 - RNA, 38 nt, Artificial Sequence
  Description of Artificial Sequence:  Enzymatic Nucleic Acid
aaaugcagcugaugaggccguuaggccgaaagcuccuc

SEQ ID NO: 4592 - RNA, 38 nt, Artificial Sequence
  Description of Artificial Sequence:  Enzymatic Nucleic Acid
gaaaugcacugaugaggccguuaggccgaaaagcuccu

SEQ ID NO: 4593 - RNA, 38 nt, Artificial Sequence
  Description of Artificial Sequence:  Enzymatic Nucleic Acid
ggcuuggacugaugaggccguuaggccgaaaugcagaa

SEQ ID NO: 4594 - RNA, 38 nt, Artificial Sequence
  Description of Artificial Sequence:  Enzymatic Nucleic Acid
uggcuuggcugaugaggccguuaggccgaaaaugcaga

SEQ ID NO: 4595 - RNA, 38 nt, Artificial Sequence
  Description of Artificial Sequence:  Enzymatic Nucleic Acid
cuggcuugcugaugaggccguuaggccgaaaaaugcag

SEQ ID NO: 4596 - RNA, 38 nt, Artificial Sequence
  Description of Artificial Sequence:  Enzymatic Nucleic Acid
acaugaggcugaugaggccguuaggccgaaacuccuuc

SEQ ID NO: 4597 - RNA, 38 nt, Artificial Sequence
  Description of Artificial Sequence:  Enzymatic Nucleic Acid
cacaugagcugaugaggccguuaggccgaaaacuccuu

SEQ ID NO: 4598 - RNA, 38 nt, Artificial Sequence
  Description of Artificial Sequence:  Enzymatic Nucleic Acid
uugcacaucugaugaggccguuaggccgaaaggaacuc

SEQ ID NO: 4599 - RNA, 38 nt, Artificial Sequence
  Description of Artificial Sequence:  Enzymatic Nucleic Acid
ccuccuggcugaugaggccguuaggccgaaacuugcac

SEQ ID NO: 4600 - RNA, 38 nt, Artificial Sequence
  Description of Artificial Sequence:  Enzymatic Nucleic Acid
gccuccugcugaugaggccguuaggccgaaaacuugca

SEQ ID NO: 4601 - RNA, 38 nt, Artificial Sequence
  Description of Artificial Sequence:  Enzymatic Nucleic Acid
uccaggcccugaugaggccguuaggccgaaagucucuc

SEQ ID NO: 4602 - RNA, 38 nt, Artificial Sequence
  Description of Artificial Sequence:  Enzymatic Nucleic Acid
uucagauccugaugaggccguuaggccgaaagcuucuc

SEQ ID NO: 4603 - RNA, 38 nt, Artificial Sequence
  Description of Artificial Sequence:  Enzymatic Nucleic Acid
ccucuucacugaugaggccguuaggccgaaaucgagcu

SEQ ID NO: 4604 - RNA, 38 nt, Artificial Sequence
  Description of Artificial Sequence:  Enzymatic Nucleic Acid
cucccgcacugaugaggccguuaggccgaaagccugcu

SEQ ID NO: 4605 - RNA, 38 nt, Artificial Sequence
  Description of Artificial Sequence:  Enzymatic Nucleic Acid
cuuucacacugaugaggccguuaggccgaaaggccuug

SEQ ID NO: 4606 - RNA, 38 nt, Artificial Sequence
  Description of Artificial Sequence:  Enzymatic Nucleic Acid
cgagcaagcugaugaggccguuaggccgaaacgucacc

SEQ ID NO: 4607 - RNA, 38 nt, Artificial Sequence
  Description of Artificial Sequence:  Enzymatic Nucleic Acid
ccccgagccugaugaggccguuaggccgaaaggacguc

SEQ ID NO: 4608 - RNA, 38 nt, Artificial Sequence
  Description of Artificial Sequence:  Enzymatic Nucleic Acid
agcucccccugaugaggccguuaggccgaaagcaagga

SEQ ID NO: 4609 - RNA, 38 nt, Artificial Sequence
  Description of Artificial Sequence:  Enzymatic Nucleic Acid
cuccaagccugaugaggccguuaggccgaaacucuggc

SEQ ID NO: 4610 - RNA, 38 nt, Artificial Sequence
  Description of Artificial Sequence:  Enzymatic Nucleic Acid
cagccucccugaugaggccguuaggccgaaagcgacuc

SEQ ID NO: 4611 - RNA, 38 nt, Artificial Sequence
  Description of Artificial Sequence:  Enzymatic Nucleic Acid
gcauuccucugaugaggccguuaggccgaaaguggcag

SEQ ID NO: 4612 - RNA, 38 nt, Artificial Sequence
  Description of Artificial Sequence:  Enzymatic Nucleic Acid
acccuccacugaugaggccguuaggccgaaagccuggc

SEQ ID NO: 4613 - RNA, 38 nt, Artificial Sequence
  Description of Artificial Sequence:  Enzymatic Nucleic Acid
ccgggccccugaugaggccguuaggccgaaacccucca

SEQ ID NO: 4614 - RNA, 38 nt, Artificial Sequence
  Description of Artificial Sequence:  Enzymatic Nucleic Acid
uccaugcgcugaugaggccguuaggccgaaagcgcggc

SEQ ID NO: 4615 - RNA, 38 nt, Artificial Sequence
  Description of Artificial Sequence:  Enzymatic Nucleic Acid
ucuccucccugaugaggccguuaggccgaaaggcggcc

SEQ ID NO: 4616 - RNA, 38 nt, Artificial Sequence
  Description of Artificial Sequence:  Enzymatic Nucleic Acid
ccaccugccugaugaggccguuaggccgaaacugggcc

SEQ ID NO: 4617 - RNA, 38 nt, Artificial Sequence
  Description of Artificial Sequence:  Enzymatic Nucleic Acid
gcuggugacugaugaggccguuaggccgaaaggccacc

SEQ ID NO: 4618 - RNA, 38 nt, Artificial Sequence
  Description of Artificial Sequence:  Enzymatic Nucleic Acid
gagcuggucugaugaggccguuaggccgaaauaggcca

SEQ ID NO: 4619 - RNA, 38 nt, Artificial Sequence
  Description of Artificial Sequence:  Enzymatic Nucleic Acid
ucuuggaacugaugaggccguuaggccgaaagcuggug

SEQ ID NO: 4620 - RNA, 38 nt, Artificial Sequence
  Description of Artificial Sequence:  Enzymatic Nucleic Acid
auucuuggcugaugaggccguuaggccgaaagagcugg

SEQ ID NO: 4621 - RNA, 38 nt, Artificial Sequence
  Description of Artificial Sequence:  Enzymatic Nucleic Acid
uauucuugcugaugaggccguuaggccgaaaagagcug

SEQ ID NO: 4622 - RNA, 38 nt, Artificial Sequence
  Description of Artificial Sequence:  Enzymatic Nucleic Acid
gguugucgcugaugaggccguuaggccgaaauucuugg

SEQ ID NO: 4623 - RNA, 38 nt, Artificial Sequence
  Description of Artificial Sequence:  Enzymatic Nucleic Acid
cugcucuucugaugaggccguuaggccgaaaugugguu

SEQ ID NO: 4624 - RNA, 38 nt, Artificial Sequence
  Description of Artificial Sequence:  Enzymatic Nucleic Acid
cuguuugacugaugaggccguuaggccgaaaucuucca

SEQ ID NO: 4625 - RNA, 38 nt, Artificial Sequence
  Description of Artificial Sequence:  Enzymatic Nucleic Acid
ugcuguuucugaugaggccguuaggccgaaagaucuuc

SEQ ID NO: 4626 - RNA, 38 nt, Artificial Sequence
  Description of Artificial Sequence:  Enzymatic Nucleic Acid
gccugcugcugaugaggccguuaggccgaaagcugcug

SEQ ID NO: 4627 - RNA, 38 nt, Artificial Sequence
  Description of Artificial Sequence:  Enzymatic Nucleic Acid
agcuuauccugaugaggccguuaggccgaaaucaccuc

SEQ ID NO: 4628 - RNA, 38 nt, Artificial Sequence
  Description of Artificial Sequence:  Enzymatic Nucleic Acid
cuucagcucugaugaggccguuaggccgaaaucgauca

SEQ ID NO: 4629 - RNA, 38 nt, Artificial Sequence
  Description of Artificial Sequence:  Enzymatic Nucleic Acid
uccaucaccugaugaggccguuaggccgaaaucuugug

SEQ ID NO: 4630 - RNA, 38 nt, Artificial Sequence
  Description of Artificial Sequence:  Enzymatic Nucleic Acid
agcaccggcugaugaggccguuaggccgaaacggucuc

SEQ ID NO: 4631 - RNA, 38 nt, Artificial Sequence
  Description of Artificial Sequence:  Enzymatic Nucleic Acid
cagcaccgcugaugaggccguuaggccgaaaacggucu

SEQ ID NO: 4632 - RNA, 38 nt, Artificial Sequence
  Description of Artificial Sequence:  Enzymatic Nucleic Acid
cuuguagacugaugaggccguuaggccgaaauccgccu

SEQ ID NO: 4633 - RNA, 38 nt, Artificial Sequence
  Description of Artificial Sequence:  Enzymatic Nucleic Acid
gccuuguacugaugaggccguuaggccgaaauauccgc

SEQ ID NO: 4634 - RNA, 38 nt, Artificial Sequence
  Description of Artificial Sequence:  Enzymatic Nucleic Acid
ccgccuugcugaugaggccguuaggccgaaagauaucc

SEQ ID NO: 4635 - RNA, 38 nt, Artificial Sequence
  Description of Artificial Sequence:  Enzymatic Nucleic Acid
cagccuggcugaugaggccguuaggccgaaaguccgcc

SEQ ID NO: 4636 - RNA, 38 nt, Artificial Sequence
  Description of Artificial Sequence:  Enzymatic Nucleic Acid
ucagccugcugaugaggccguuaggccgaaaaguccgc

SEQ ID NO: 4637 - RNA, 38 nt, Artificial Sequence
  Description of Artificial Sequence:  Enzymatic Nucleic Acid
uccugcagcugaugaggccguuaggccgaaagcuccuu

SEQ ID NO: 4638 - RNA, 38 nt, Artificial Sequence
  Description of Artificial Sequence:  Enzymatic Nucleic Acid
guuugcugcugaugaggccguuaggccgaaacucccuc

SEQ ID NO: 4639 - RNA, 38 nt, Artificial Sequence
  Description of Artificial Sequence:  Enzymatic Nucleic Acid
cgacuccucugaugaggccguuaggccgaaacagcugg

SEQ ID NO: 4640 - RNA, 38 nt, Artificial Sequence
  Description of Artificial Sequence:  Enzymatic Nucleic Acid
uccuggcccugaugaggccguuaggccgaaacuccuga

SEQ ID NO: 4641 - RNA, 38 nt, Artificial Sequence
  Description of Artificial Sequence:  Enzymatic Nucleic Acid
auguccuccugaugaggccguuaggccgaaauccuggc

SEQ ID NO: 4642 - RNA, 38 nt, Artificial Sequence
  Description of Artificial Sequence:  Enzymatic Nucleic Acid
gagaccuccugaugaggccguuaggccgaaacaugccg

SEQ ID NO: 4643 - RNA, 38 nt, Artificial Sequence
  Description of Artificial Sequence:  Enzymatic Nucleic Acid
gccugggacugaugaggccguuaggccgaaaccucgac

SEQ ID NO: 4644 - RNA, 38 nt, Artificial Sequence
  Description of Artificial Sequence:  Enzymatic Nucleic Acid
gggccuggcugaugaggccguuaggccgaaagaccucg

SEQ ID NO: 4645 - RNA, 38 nt, Artificial Sequence
  Description of Artificial Sequence:  Enzymatic Nucleic Acid
cggggggccugaugaggccguuaggccgaaagggggcc

SEQ ID NO: 4646 - RNA, 38 nt, Artificial Sequence
  Description of Artificial Sequence:  Enzymatic Nucleic Acid
aggagaggcugaugaggccguuaggccgaaaggcaggg

SEQ ID NO: 4647 - RNA, 38 nt, Artificial Sequence
  Description of Artificial Sequence:  Enzymatic Nucleic Acid
ggagaggacugaugaggccguuaggccgaaagguaggc

SEQ ID NO: 4648 - RNA, 38 nt, Artificial Sequence
  Description of Artificial Sequence:  Enzymatic Nucleic Acid
ggggagagcugaugaggccguuaggccgaaagagguag

SEQ ID NO: 4649 - RNA, 38 nt, Artificial Sequence
  Description of Artificial Sequence:  Enzymatic Nucleic Acid
ccaggggacugaugaggccguuaggccgaaaggagagg

SEQ ID NO: 4650 - RNA, 38 nt, Artificial Sequence
  Description of Artificial Sequence:  Enzymatic Nucleic Acid
ggccagggcugaugaggccguuaggccgaaagaggaga

SEQ ID NO: 4651 - RNA, 38 nt, Artificial Sequence
  Description of Artificial Sequence:  Enzymatic Nucleic Acid
gacagcagcugaugaggccguuaggccgaaagucaggu

SEQ ID NO: 4652 - RNA, 38 nt, Artificial Sequence
  Description of Artificial Sequence:  Enzymatic Nucleic Acid
ggacagcacugaugaggccguuaggccgaaaagucagg

SEQ ID NO: 4653 - RNA, 38 nt, Artificial Sequence
  Description of Artificial Sequence:  Enzymatic Nucleic Acid
gcacuuggcugaugaggccguuaggccgaaacagcaga

SEQ ID NO: 4654 - RNA, 38 nt, Artificial Sequence
  Description of Artificial Sequence:  Enzymatic Nucleic Acid
gggccugacugaugaggccguuaggccgaaacuggcac

SEQ ID NO: 4655 - RNA, 38 nt, Artificial Sequence
  Description of Artificial Sequence:  Enzymatic Nucleic Acid
aggggccucugaugaggccguuaggccgaaauacuggc

SEQ ID NO: 4656 - RNA, 38 nt, Artificial Sequence
  Description of Artificial Sequence:  Enzymatic Nucleic Acid
gguguccacugaugaggccguuaggccgaaaucagggg

SEQ ID NO: 4657 - RNA, 38 nt, Artificial Sequence
  Description of Artificial Sequence:  Enzymatic Nucleic Acid
augacaugcugaugaggccguuaggccgaaaucugcag

SEQ ID NO: 4658 - RNA, 38 nt, Artificial Sequence
  Description of Artificial Sequence:  Enzymatic Nucleic Acid
cacuccaucugaugaggccguuaggccgaaacauguau

SEQ ID NO: 4659 - RNA, 38 nt, Artificial Sequence
  Description of Artificial Sequence:  Enzymatic Nucleic Acid
cccuacuccugaugaggccguuaggccgaaaugcacuc

SEQ ID NO: 4660 - RNA, 38 nt, Artificial Sequence
  Description of Artificial Sequence:  Enzymatic Nucleic Acid
gccggccccugaugaggccguuaggccgaaacucaaug

SEQ ID NO: 4661 - RNA, 38 nt, Artificial Sequence
  Description of Artificial Sequence:  Enzymatic Nucleic Acid
aaagcgcacugaugaggccguuaggccgaaacugcacg

SEQ ID NO: 4662 - RNA, 38 nt, Artificial Sequence
  Description of Artificial Sequence:  Enzymatic Nucleic Acid
ggagaggacugaugaggccguuaggccgaaagcgcaga

SEQ ID NO: 4663 - RNA, 38 nt, Artificial Sequence
  Description of Artificial Sequence:  Enzymatic Nucleic Acid
gggagaggcugaugaggccguuaggccgaaaagcgcag

SEQ ID NO: 4664 - RNA, 38 nt, Artificial Sequence
  Description of Artificial Sequence:  Enzymatic Nucleic Acid
cgggagagcugaugaggccguuaggccgaaaaagcgca

SEQ ID NO: 4665 - RNA, 38 nt, Artificial Sequence
  Description of Artificial Sequence:  Enzymatic Nucleic Acid
aggcgggacugaugaggccguuaggccgaaaggaaagc

SEQ ID NO: 4666 - RNA, 38 nt, Artificial Sequence
  Description of Artificial Sequence:  Enzymatic Nucleic Acid
gcaggcggcugaugaggccguuaggccgaaagaggaaa

SEQ ID NO: 4667 - RNA, 38 nt, Artificial Sequence
  Description of Artificial Sequence:  Enzymatic Nucleic Acid
uccugggccugaugaggccguuaggccgaaaggcaggc

SEQ ID NO: 4668 - RNA, 38 nt, Artificial Sequence
  Description of Artificial Sequence:  Enzymatic Nucleic Acid
ugaagcgucugaugaggccguuaggccgaaaggugccg

SEQ ID NO: 4669 - RNA, 38 nt, Artificial Sequence
  Description of Artificial Sequence:  Enzymatic Nucleic Acid
cugaagcgcugaugaggccguuaggccgaaaaggugcc

SEQ ID NO: 4670 - RNA, 38 nt, Artificial Sequence
  Description of Artificial Sequence:  Enzymatic Nucleic Acid
aacagcugcugaugaggccguuaggccgaaagcguaag

SEQ ID NO: 4671 - RNA, 38 nt, Artificial Sequence
  Description of Artificial Sequence:  Enzymatic Nucleic Acid
caacagcucugaugaggccguuaggccgaaaagcguaa

SEQ ID NO: 4672 - RNA, 38 nt, Artificial Sequence
  Description of Artificial Sequence:  Enzymatic Nucleic Acid
agcggauccugaugaggccguuaggccgaaacagcuga

SEQ ID NO: 4673 - RNA, 38 nt, Artificial Sequence
  Description of Artificial Sequence:  Enzymatic Nucleic Acid
gaccagcgcugaugaggccguuaggccgaaaucaacag

SEQ ID NO: 4674 - RNA, 38 nt, Artificial Sequence
  Description of Artificial Sequence:  Enzymatic Nucleic Acid
aaagagggcugaugaggccguuaggccgaaaccagcgg

SEQ ID NO: 4675 - RNA, 38 nt, Artificial Sequence
  Description of Artificial Sequence:  Enzymatic Nucleic Acid
ccccaaaacugaugaggccguuaggccgaaaggggacc

SEQ ID NO: 4676 - RNA, 38 nt, Artificial Sequence
  Description of Artificial Sequence:  Enzymatic Nucleic Acid
uaccccaacugaugaggccguuaggccgaaagagggga

SEQ ID NO: 4677 - RNA, 38 nt, Artificial Sequence
  Description of Artificial Sequence:  Enzymatic Nucleic Acid
cuaccccacugaugaggccguuaggccgaaaagagggg

SEQ ID NO: 4678 - RNA, 38 nt, Artificial Sequence
  Description of Artificial Sequence:  Enzymatic Nucleic Acid
ucuacccccugaugaggccguuaggccgaaaaagaggg

SEQ ID NO: 4679 - RNA, 38 nt, Artificial Sequence
  Description of Artificial Sequence:  Enzymatic Nucleic Acid
gccgcauccugaugaggccguuaggccgaaaccccaaa

SEQ ID NO: 4680 - RNA, 38 nt, Artificial Sequence
  Description of Artificial Sequence:  Enzymatic Nucleic Acid
ucaggccucugaugaggccguuaggccgaaaucggggc

SEQ ID NO: 4681 - RNA, 38 nt, Artificial Sequence
  Description of Artificial Sequence:  Enzymatic Nucleic Acid
agagcagccugaugaggccguuaggccgaaagucaggc

SEQ ID NO: 4682 - RNA, 38 nt, Artificial Sequence
  Description of Artificial Sequence:  Enzymatic Nucleic Acid
aacaaaaacugaugaggccguuaggccgaaagcagcga

SEQ ID NO: 4683 - RNA, 38 nt, Artificial Sequence
  Description of Artificial Sequence:  Enzymatic Nucleic Acid
ggaacaaacugaugaggccguuaggccgaaagagcagc

SEQ ID NO: 4684 - RNA, 38 nt, Artificial Sequence
  Description of Artificial Sequence:  Enzymatic Nucleic Acid
gggaacaacugaugaggccguuaggccgaaaagagcag

SEQ ID NO: 4685 - RNA, 38 nt, Artificial Sequence
  Description of Artificial Sequence:  Enzymatic Nucleic Acid
agggaacacugaugaggccguuaggccgaaaaagagca

SEQ ID NO: 4686 - RNA, 38 nt, Artificial Sequence
  Description of Artificial Sequence:  Enzymatic Nucleic Acid
aagggaaccugaugaggccguuaggccgaaaaaagagc

SEQ ID NO: 4687 - RNA, 38 nt, Artificial Sequence
  Description of Artificial Sequence:  Enzymatic Nucleic Acid
cagaagggcugaugaggccguuaggccgaaacaaaaag

SEQ ID NO: 4688 - RNA, 38 nt, Artificial Sequence
  Description of Artificial Sequence:  Enzymatic Nucleic Acid
acagaaggcugaugaggccguuaggccgaaaacaaaaa

SEQ ID NO: 4689 - RNA, 38 nt, Artificial Sequence
  Description of Artificial Sequence:  Enzymatic Nucleic Acid
gcagacagcugaugaggccguuaggccgaaagggaaca

SEQ ID NO: 4690 - RNA, 38 nt, Artificial Sequence
  Description of Artificial Sequence:  Enzymatic Nucleic Acid
agcagacacugaugaggccguuaggccgaaaagggaac

SEQ ID NO: 4691 - RNA, 38 nt, Artificial Sequence
  Description of Artificial Sequence:  Enzymatic Nucleic Acid
uucgagcacugaugaggccguuaggccgaaacagaagg

SEQ ID NO: 4692 - RNA, 38 nt, Artificial Sequence
  Description of Artificial Sequence:  Enzymatic Nucleic Acid
agugguuccugaugaggccguuaggccgaaagcagaca

SEQ ID NO: 4693 - RNA, 38 nt, Artificial Sequence
  Description of Artificial Sequence:  Enzymatic Nucleic Acid
cccgaggccugaugaggccguuaggccgaaagugguuc

SEQ ID NO: 4694 - RNA, 38 nt, Artificial Sequence
  Description of Artificial Sequence:  Enzymatic Nucleic Acid
auuagccccugaugaggccguuaggccgaaaggcaagu

SEQ ID NO: 4695 - RNA, 38 nt, Artificial Sequence
  Description of Artificial Sequence:  Enzymatic Nucleic Acid
ggagggaucugaugaggccguuaggccgaaagcccgag

SEQ ID NO: 4696 - RNA, 38 nt, Artificial Sequence
  Description of Artificial Sequence:  Enzymatic Nucleic Acid
gagggaggcugaugaggccguuaggccgaaauuagccc

SEQ ID NO: 4697 - RNA, 38 nt, Artificial Sequence
  Description of Artificial Sequence:  Enzymatic Nucleic Acid
ggaagaggcugaugaggccguuaggccgaaagggauua

SEQ ID NO: 4698 - RNA, 38 nt, Artificial Sequence
  Description of Artificial Sequence:  Enzymatic Nucleic Acid
uggaggaacugaugaggccguuaggccgaaagggaggg

SEQ ID NO: 4699 - RNA, 38 nt, Artificial Sequence
  Description of Artificial Sequence:  Enzymatic Nucleic Acid
gguggaggcugaugaggccguuaggccgaaagagggag

SEQ ID NO: 4700 - RNA, 38 nt, Artificial Sequence
  Description of Artificial Sequence:  Enzymatic Nucleic Acid
ggguggagcugaugaggccguuaggccgaaaagaggga

SEQ ID NO: 4701 - RNA, 38 nt, Artificial Sequence
  Description of Artificial Sequence:  Enzymatic Nucleic Acid
gccgggugcugaugaggccguuaggccgaaaggaagag

SEQ ID NO: 4702 - RNA, 38 nt, Artificial Sequence
  Description of Artificial Sequence:  Enzymatic Nucleic Acid
ccauucuucugaugaggccguuaggccgaaacuucccc

SEQ ID NO: 4703 - RNA, 38 nt, Artificial Sequence
  Description of Artificial Sequence:  Enzymatic Nucleic Acid
cucccugacugaugaggccguuaggccgaaagccccag

SEQ ID NO: 4704 - RNA, 38 nt, Artificial Sequence
  Description of Artificial Sequence:  Enzymatic Nucleic Acid
uucucccucugaugaggccguuaggccgaaagagcccc

SEQ ID NO: 4705 - RNA, 38 nt, Artificial Sequence
  Description of Artificial Sequence:  Enzymatic Nucleic Acid
gccaggggcugaugaggccguuaggccgaaagcaguuc

SEQ ID NO: 4706 - RNA, 38 nt, Artificial Sequence
  Description of Artificial Sequence:  Enzymatic Nucleic Acid
ugccagggcugaugaggccguuaggccgaaaagcaguu

SEQ ID NO: 4707 - RNA, 38 nt, Artificial Sequence
  Description of Artificial Sequence:  Enzymatic Nucleic Acid
gggaggaacugaugaggccguuaggccgaaagcugcca

SEQ ID NO: 4708 - RNA, 38 nt, Artificial Sequence
  Description of Artificial Sequence:  Enzymatic Nucleic Acid
gugggaggcugaugaggccguuaggccgaaagagcugc

SEQ ID NO: 4709 - RNA, 38 nt, Artificial Sequence
  Description of Artificial Sequence:  Enzymatic Nucleic Acid
ggugggagcugaugaggccguuaggccgaaaagagcug

SEQ ID NO: 4710 - RNA, 38 nt, Artificial Sequence
  Description of Artificial Sequence:  Enzymatic Nucleic Acid
uccgguggcugaugaggccguuaggccgaaaggaagag

SEQ ID NO: 4711 - RNA, 38 nt, Artificial Sequence
  Description of Artificial Sequence:  Enzymatic Nucleic Acid
caugguaacugaugaggccguuaggccgaaagggcagc

SEQ ID NO: 4712 - RNA, 38 nt, Artificial Sequence
  Description of Artificial Sequence:  Enzymatic Nucleic Acid
ugcauggucugaugaggccguuaggccgaaagagggca

SEQ ID NO: 4713 - RNA, 38 nt, Artificial Sequence
  Description of Artificial Sequence:  Enzymatic Nucleic Acid
gugcauggcugaugaggccguuaggccgaaaagagggc

SEQ ID NO: 4714 - RNA, 38 nt, Artificial Sequence
  Description of Artificial Sequence:  Enzymatic Nucleic Acid
caaaaggacugaugaggccguuaggccgaaagcacccg

SEQ ID NO: 4715 - RNA, 38 nt, Artificial Sequence
  Description of Artificial Sequence:  Enzymatic Nucleic Acid
cccaaaagcugaugaggccguuaggccgaaagagcacc

SEQ ID NO: 4716 - RNA, 38 nt, Artificial Sequence
  Description of Artificial Sequence:  Enzymatic Nucleic Acid
cagcccaacugaugaggccguuaggccgaaaggagagc

SEQ ID NO: 4717 - RNA, 38 nt, Artificial Sequence
  Description of Artificial Sequence:  Enzymatic Nucleic Acid
gcagcccacugaugaggccguuaggccgaaaaggagag

SEQ ID NO: 4718 - RNA, 38 nt, Artificial Sequence
  Description of Artificial Sequence:  Enzymatic Nucleic Acid
ugcagccccugaugaggccguuaggccgaaaaaggaga

SEQ ID NO: 4719 - RNA, 38 nt, Artificial Sequence
  Description of Artificial Sequence:  Enzymatic Nucleic Acid
aaauggaacugaugaggccguuaggccgaaagcaugca

SEQ ID NO: 4720 - RNA, 38 nt, Artificial Sequence
  Description of Artificial Sequence:  Enzymatic Nucleic Acid
caaaauggcugaugaggccguuaggccgaaauagcaug

SEQ ID NO: 4721 - RNA, 38 nt, Artificial Sequence
  Description of Artificial Sequence:  Enzymatic Nucleic Acid
gcaaaaugcugaugaggccguuaggccgaaaauagcau

SEQ ID NO: 4722 - RNA, 38 nt, Artificial Sequence
  Description of Artificial Sequence:  Enzymatic Nucleic Acid
ggcugcaacugaugaggccguuaggccgaaauggaaua

SEQ ID NO: 4723 - RNA, 38 nt, Artificial Sequence
  Description of Artificial Sequence:  Enzymatic Nucleic Acid
uggcugcacugaugaggccguuaggccgaaaauggaau

SEQ ID NO: 4724 - RNA, 38 nt, Artificial Sequence
  Description of Artificial Sequence:  Enzymatic Nucleic Acid
cuggcugccugaugaggccguuaggccgaaaaauggaa

SEQ ID NO: 4725 - RNA, 38 nt, Artificial Sequence
  Description of Artificial Sequence:  Enzymatic Nucleic Acid
ugguuaaacugaugaggccguuaggccgaaacacaucg

SEQ ID NO: 4726 - RNA, 38 nt, Artificial Sequence
  Description of Artificial Sequence:  Enzymatic Nucleic Acid
acugguuacugaugaggccguuaggccgaaauacacau

SEQ ID NO: 4727 - RNA, 38 nt, Artificial Sequence
  Description of Artificial Sequence:  Enzymatic Nucleic Acid
gacugguucugaugaggccguuaggccgaaaauacaca

SEQ ID NO: 4728 - RNA, 38 nt, Artificial Sequence
  Description of Artificial Sequence:  Enzymatic Nucleic Acid
ugacuggucugaugaggccguuaggccgaaaaauacac

SEQ ID NO: 4729 - RNA, 38 nt, Artificial Sequence
  Description of Artificial Sequence:  Enzymatic Nucleic Acid
ucaauagucugaugaggccguuaggccgaaacugguua

SEQ ID NO: 4730 - RNA, 38 nt, Artificial Sequence
  Description of Artificial Sequence:  Enzymatic Nucleic Acid
uccaucaacugaugaggccguuaggccgaaagugacug

SEQ ID NO: 4731 - RNA, 38 nt, Artificial Sequence
  Description of Artificial Sequence:  Enzymatic Nucleic Acid
uguccauccugaugaggccguuaggccgaaauagugac

SEQ ID NO: 4732 - RNA, 38 nt, Artificial Sequence
  Description of Artificial Sequence:  Enzymatic Nucleic Acid
acaacccacugaugaggccguuaggccgaaauguccau

SEQ ID NO: 4733 - RNA, 38 nt, Artificial Sequence
  Description of Artificial Sequence:  Enzymatic Nucleic Acid
aacaaccccugaugaggccguuaggccgaaaaugucca

SEQ ID NO: 4734 - RNA, 38 nt, Artificial Sequence
  Description of Artificial Sequence:  Enzymatic Nucleic Acid
ugggaaaccugaugaggccguuaggccgaaacccaaau

SEQ ID NO: 4735 - RNA, 38 nt, Artificial Sequence
  Description of Artificial Sequence:  Enzymatic Nucleic Acid
agaugggacugaugaggccguuaggccgaaacaaccca

SEQ ID NO: 4736 - RNA, 38 nt, Artificial Sequence
  Description of Artificial Sequence:  Enzymatic Nucleic Acid
aagaugggcugaugaggccguuaggccgaaaacaaccc

SEQ ID NO: 4737 - RNA, 38 nt, Artificial Sequence
  Description of Artificial Sequence:  Enzymatic Nucleic Acid
aaagauggcugaugaggccguuaggccgaaaaacaacc

SEQ ID NO: 4738 - RNA, 38 nt, Artificial Sequence
  Description of Artificial Sequence:  Enzymatic Nucleic Acid
aacaaaaacugaugaggccguuaggccgaaaugggaaa

SEQ ID NO: 4739 - RNA, 38 nt, Artificial Sequence
  Description of Artificial Sequence:  Enzymatic Nucleic Acid
guaacaaacugaugaggccguuaggccgaaagauggga

SEQ ID NO: 4740 - RNA, 38 nt, Artificial Sequence
  Description of Artificial Sequence:  Enzymatic Nucleic Acid
gguaacaacugaugaggccguuaggccgaaaagauggg

SEQ ID NO: 4741 - RNA, 38 nt, Artificial Sequence
  Description of Artificial Sequence:  Enzymatic Nucleic Acid
ugguaacacugaugaggccguuaggccgaaaaagaugg

SEQ ID NO: 4742 - RNA, 38 nt, Artificial Sequence
  Description of Artificial Sequence:  Enzymatic Nucleic Acid
augguaaccugaugaggccguuaggccgaaaaaagaug

SEQ ID NO: 4743 - RNA, 38 nt, Artificial Sequence
  Description of Artificial Sequence:  Enzymatic Nucleic Acid
uuuauggucugaugaggccguuaggccgaaacaaaaag

SEQ ID NO: 4744 - RNA, 38 nt, Artificial Sequence
  Description of Artificial Sequence:  Enzymatic Nucleic Acid
auuuauggcugaugaggccguuaggccgaaaacaaaaa

SEQ ID NO: 4745 - RNA, 38 nt, Artificial Sequence
  Description of Artificial Sequence:  Enzymatic Nucleic Acid
ccauuauucugaugaggccguuaggccgaaaugguaac

SEQ ID NO: 4746 - RNA, 38 nt, Artificial Sequence
  Description of Artificial Sequence:  Enzymatic Nucleic Acid
uaugccaucugaugaggccguuaggccgaaauuuaugg

SEQ ID NO: 4747 - RNA, 38 nt, Artificial Sequence
  Description of Artificial Sequence:  Enzymatic Nucleic Acid
uuuuuuaccugaugaggccguuaggccgaaaugccauu

SEQ ID NO: 4748 - RNA, 38 nt, Artificial Sequence
  Description of Artificial Sequence:  Enzymatic Nucleic Acid
uuuuuuuucugaugaggccguuaggccgaaacuaugcc

SEQ ID NO: 4749 - RNA, 17 nt, Homo sapiens
gcacgagcauggcccuu

SEQ ID NO: 4750 - RNA, 17 nt, Homo sapiens
agcauggcccuugugau

SEQ ID NO: 4751 - RNA, 17 nt, Homo sapiens
gcauggcccuugugauc

SEQ ID NO: 4752 - RNA, 17 nt, Homo sapiens
cauggcccuugugaucc

SEQ ID NO: 4753 - RNA, 17 nt, Homo sapiens
uugugauccaggugggg

SEQ ID NO: 4754 - RNA, 17 nt, Homo sapiens
ugugauccaggugggga

SEQ ID NO: 4755 - RNA, 17 nt, Homo sapiens
ggggaaacuaaggccca

SEQ ID NO: 4756 - RNA, 17 nt, Homo sapiens
acuaaggcccagagaag

SEQ ID NO: 4757 - RNA, 17 nt, Homo sapiens
cuaaggcccagagaagu

SEQ ID NO: 4758 - RNA, 17 nt, Homo sapiens
uaaggcccagagaagug

SEQ ID NO: 4759 - RNA, 17 nt, Homo sapiens
gugaggaccccgcagac

SEQ ID NO: 4760 - RNA, 17 nt, Homo sapiens
ugaggaccccgcagacu

SEQ ID NO: 4761 - RNA, 17 nt, Homo sapiens
gaggaccccgcagacua

SEQ ID NO: 4762 - RNA, 17 nt, Homo sapiens
gaccccgcagacuauca

SEQ ID NO: 4763 - RNA, 17 nt, Homo sapiens
ccgcagacuaucaaucc

SEQ ID NO: 4764 - RNA, 17 nt, Homo sapiens
agacuaucaaucccagu

SEQ ID NO: 4765 - RNA, 17 nt, Homo sapiens
uaucaaucccagucucu

SEQ ID NO: 4766 - RNA, 17 nt, Homo sapiens
aucaaucccagucucuu

SEQ ID NO: 4767 - RNA, 17 nt, Homo sapiens
ucaaucccagucucuuc

SEQ ID NO: 4768 - RNA, 17 nt, Homo sapiens
ucccagucucuuccccu

SEQ ID NO: 4769 - RNA, 17 nt, Homo sapiens
ccagucucuuccccuca

SEQ ID NO: 4770 - RNA, 17 nt, Homo sapiens
gucucuuccccucacuc

SEQ ID NO: 4771 - RNA, 17 nt, Homo sapiens
ucucuuccccucacucc

SEQ ID NO: 4772 - RNA, 17 nt, Homo sapiens
cucuuccccucacuccc

SEQ ID NO: 4773 - RNA, 17 nt, Homo sapiens
ucuuccccucacucccu

SEQ ID NO: 4774 - RNA, 17 nt, Homo sapiens
uuccccucacucccugu

SEQ ID NO: 4775 - RNA, 17 nt, Homo sapiens
ccccucacucccuguga

SEQ ID NO: 4776 - RNA, 17 nt, Homo sapiens
ccucacucccugugaag

SEQ ID NO: 4777 - RNA, 17 nt, Homo sapiens
cucacucccugugaagc

SEQ ID NO: 4778 - RNA, 17 nt, Homo sapiens
ucacucccugugaagcu

SEQ ID NO: 4779 - RNA, 17 nt, Homo sapiens
ugugaagcucuccagca

SEQ ID NO: 4780 - RNA, 17 nt, Homo sapiens
ugaagcucuccagcauc

SEQ ID NO: 4781 - RNA, 17 nt, Homo sapiens
aagcucuccagcaucau

SEQ ID NO: 4782 - RNA, 17 nt, Homo sapiens
agcucuccagcaucauc

SEQ ID NO: 4783 - RNA, 17 nt, Homo sapiens
ucuccagcaucaucgag

SEQ ID NO: 4784 - RNA, 17 nt, Homo sapiens
ccagcaucaucgagguc

SEQ ID NO: 4785 - RNA, 17 nt, Homo sapiens
ucgaggucccaucagcc

SEQ ID NO: 4786 - RNA, 17 nt, Homo sapiens
cgaggucccaucagccc

SEQ ID NO: 4787 - RNA, 17 nt, Homo sapiens
gaggucccaucagcccu

SEQ ID NO: 4788 - RNA, 17 nt, Homo sapiens
gucccaucagcccuugc

SEQ ID NO: 4789 - RNA, 17 nt, Homo sapiens
ccaucagcccuugcccu

SEQ ID NO: 4790 - RNA, 17 nt, Homo sapiens
caucagcccuugcccug

SEQ ID NO: 4791 - RNA, 17 nt, Homo sapiens
aucagcccuugcccugu

SEQ ID NO: 4792 - RNA, 17 nt, Homo sapiens
gcccuugcccuguugga

SEQ ID NO: 4793 - RNA, 17 nt, Homo sapiens
cccuugcccuguuggau

SEQ ID NO: 4794 - RNA, 17 nt, Homo sapiens
ccuugcccuguuggaug

SEQ ID NO: 4795 - RNA, 17 nt, Homo sapiens
gaauaggcaccucugga

SEQ ID NO: 4796 - RNA, 17 nt, Homo sapiens
auaggcaccucuggaag

SEQ ID NO: 4797 - RNA, 17 nt, Homo sapiens
uaggcaccucuggaaga

SEQ ID NO: 4798 - RNA, 17 nt, Homo sapiens
ggcaccucuggaagagc

SEQ ID NO: 4799 - RNA, 17 nt, Homo sapiens
ggaagagccaacugugu

SEQ ID NO: 4800 - RNA, 17 nt, Homo sapiens
gaagagccaacugugug

SEQ ID NO: 4801 - RNA, 17 nt, Homo sapiens
gagccaacugugugaga

SEQ ID NO: 4802 - RNA, 17 nt, Homo sapiens
gauggugcagcccagug

SEQ ID NO: 4803 - RNA, 17 nt, Homo sapiens
ggugcagcccaguggug

SEQ ID NO: 4804 - RNA, 17 nt, Homo sapiens
gugcagcccaguggugg

SEQ ID NO: 4805 - RNA, 17 nt, Homo sapiens
ugcagcccagugguggc

SEQ ID NO: 4806 - RNA, 17 nt, Homo sapiens
gugguggcccggcagca

SEQ ID NO: 4807 - RNA, 17 nt, Homo sapiens
ugguggcccggcagcag

SEQ ID NO: 4808 - RNA, 17 nt, Homo sapiens
ggcccggcagcagauca

SEQ ID NO: 4809 - RNA, 17 nt, Homo sapiens
ccggcagcagaucagga

SEQ ID NO: 4810 - RNA, 17 nt, Homo sapiens
agcagaucaggacguac

SEQ ID NO: 4811 - RNA, 17 nt, Homo sapiens
ggacguacugggcgaag

SEQ ID NO: 4812 - RNA, 17 nt, Homo sapiens
gaagagucuccucuggg

SEQ ID NO: 4813 - RNA, 17 nt, Homo sapiens
agagucuccucugggga

SEQ ID NO: 4814 - RNA, 17 nt, Homo sapiens
gagucuccucuggggaa

SEQ ID NO: 4815 - RNA, 17 nt, Homo sapiens
gucuccucuggggaagc

SEQ ID NO: 4816 - RNA, 17 nt, Homo sapiens
ggggaagccagccaugc

SEQ ID NO: 4817 - RNA, 17 nt, Homo sapiens
gggaagccagccaugcu

SEQ ID NO: 4818 - RNA, 17 nt, Homo sapiens
aagccagccaugcugca

SEQ ID NO: 4819 - RNA, 17 nt, Homo sapiens
agccagccaugcugcac

SEQ ID NO: 4820 - RNA, 17 nt, Homo sapiens
agccaugcugcaccugc

SEQ ID NO: 4821 - RNA, 17 nt, Homo sapiens
caugcugcaccugccuu

SEQ ID NO: 4822 - RNA, 17 nt, Homo sapiens
ugcugcaccugccuuca

SEQ ID NO: 4823 - RNA, 17 nt, Homo sapiens
gcugcaccugccuucag

SEQ ID NO: 4824 - RNA, 17 nt, Homo sapiens
gcaccugccuucagaac

SEQ ID NO: 4825 - RNA, 17 nt, Homo sapiens
caccugccuucagaaca

SEQ ID NO: 4826 - RNA, 17 nt, Homo sapiens
cugccuucagaacaggg

SEQ ID NO: 4827 - RNA, 17 nt, Homo sapiens
uucagaacagggcgcuc

SEQ ID NO: 4828 - RNA, 17 nt, Homo sapiens
cagggcgcuccugagac

SEQ ID NO: 4829 - RNA, 17 nt, Homo sapiens
gggcgcuccugagaccc

SEQ ID NO: 4830 - RNA, 17 nt, Homo sapiens
ggcgcuccugagacccu

SEQ ID NO: 4831 - RNA, 17 nt, Homo sapiens
ccugagacccuccagcg

SEQ ID NO: 4832 - RNA, 17 nt, Homo sapiens
cugagacccuccagcgc

SEQ ID NO: 4833 - RNA, 17 nt, Homo sapiens
ugagacccuccagcgcu

SEQ ID NO: 4834 - RNA, 17 nt, Homo sapiens
agacccuccagcgcugc

SEQ ID NO: 4835 - RNA, 17 nt, Homo sapiens
gacccuccagcgcugcc

SEQ ID NO: 4836 - RNA, 17 nt, Homo sapiens
uccagcgcugccuggag

SEQ ID NO: 4837 - RNA, 17 nt, Homo sapiens
agcgcugccuggaggag

SEQ ID NO: 4838 - RNA, 17 nt, Homo sapiens
gcgcugccuggaggaga

SEQ ID NO: 4839 - RNA, 17 nt, Homo sapiens
ggagaaucaagagcucc

SEQ ID NO: 4840 - RNA, 17 nt, Homo sapiens
ucaagagcuccgagaug

SEQ ID NO: 4841 - RNA, 17 nt, Homo sapiens
aagagcuccgagaugcc

SEQ ID NO: 4842 - RNA, 17 nt, Homo sapiens
cgagaugccauccggca

SEQ ID NO: 4843 - RNA, 17 nt, Homo sapiens
gagaugccauccggcag

SEQ ID NO: 4844 - RNA, 17 nt, Homo sapiens
augccauccggcagagc

SEQ ID NO: 4845 - RNA, 17 nt, Homo sapiens
cauccggcagagcaacc

SEQ ID NO: 4846 - RNA, 17 nt, Homo sapiens
ggcagagcaaccagauu

SEQ ID NO: 4847 - RNA, 17 nt, Homo sapiens
agagcaaccagauucug

SEQ ID NO: 4848 - RNA, 17 nt, Homo sapiens
gagcaaccagauucugc

SEQ ID NO: 4849 - RNA, 17 nt, Homo sapiens
ccagauucugcgggagc

SEQ ID NO: 4850 - RNA, 17 nt, Homo sapiens
gggagcgcugcgaggag

SEQ ID NO: 4851 - RNA, 17 nt, Homo sapiens
cgaggagcuucugcauu

SEQ ID NO: 4852 - RNA, 17 nt, Homo sapiens
ggagcuucugcauuucc

SEQ ID NO: 4853 - RNA, 17 nt, Homo sapiens
gcuucugcauuuccaag

SEQ ID NO: 4854 - RNA, 17 nt, Homo sapiens
ugcauuuccaagccagc

SEQ ID NO: 4855 - RNA, 17 nt, Homo sapiens
gcauuuccaagccagcc

SEQ ID NO: 4856 - RNA, 17 nt, Homo sapiens
uuccaagccagccagag

SEQ ID NO: 4857 - RNA, 17 nt, Homo sapiens
uccaagccagccagagg

SEQ ID NO: 4858 - RNA, 17 nt, Homo sapiens
aagccagccagagggag

SEQ ID NO: 4859 - RNA, 17 nt, Homo sapiens
agccagccagagggagg

SEQ ID NO: 4860 - RNA, 17 nt, Homo sapiens
aggaguuccucaugugc

SEQ ID NO: 4861 - RNA, 17 nt, Homo sapiens
ggaguuccucaugugca

SEQ ID NO: 4862 - RNA, 17 nt, Homo sapiens
aguuccucaugugcaag

SEQ ID NO: 4863 - RNA, 17 nt, Homo sapiens
ucaugugcaaguuccag

SEQ ID NO: 4864 - RNA, 17 nt, Homo sapiens
gcaaguuccaggaggcc

SEQ ID NO: 4865 - RNA, 17 nt, Homo sapiens
caaguuccaggaggcca

SEQ ID NO: 4866 - RNA, 17 nt, Homo sapiens
caggaggccaggaaacu

SEQ ID NO: 4867 - RNA, 17 nt, Homo sapiens
aggaggccaggaaacug

SEQ ID NO: 4868 - RNA, 17 nt, Homo sapiens
caggaaacugguggaga

SEQ ID NO: 4869 - RNA, 17 nt, Homo sapiens
ggagagacucggccugg

SEQ ID NO: 4870 - RNA, 17 nt, Homo sapiens
gacucggccuggagaag

SEQ ID NO: 4871 - RNA, 17 nt, Homo sapiens
acucggccuggagaagc

SEQ ID NO: 4872 - RNA, 17 nt, Homo sapiens
ggagaagcucgaucuga

SEQ ID NO: 4873 - RNA, 17 nt, Homo sapiens
gcucgaucugaagaggc

SEQ ID NO: 4874 - RNA, 17 nt, Homo sapiens
gaagaggcagaaggagc

SEQ ID NO: 4875 - RNA, 17 nt, Homo sapiens
gaaggagcaggcucugc

SEQ ID NO: 4876 - RNA, 17 nt, Homo sapiens
gagcaggcucugcggga

SEQ ID NO: 4877 - RNA, 17 nt, Homo sapiens
gcaggcucugcgggagg

SEQ ID NO: 4878 - RNA, 17 nt, Homo sapiens
gguggagcaccugaaga

SEQ ID NO: 4879 - RNA, 17 nt, Homo sapiens
uggagcaccugaagaga

SEQ ID NO: 4880 - RNA, 17 nt, Homo sapiens
ggagcaccugaagagau

SEQ ID NO: 4881 - RNA, 17 nt, Homo sapiens
agagaugccagcagcag

SEQ ID NO: 4882 - RNA, 17 nt, Homo sapiens
gagaugccagcagcaga

SEQ ID NO: 4883 - RNA, 17 nt, Homo sapiens
augccagcagcagaugg

SEQ ID NO: 4884 - RNA, 17 nt, Homo sapiens
ccagcagcagauggcug

SEQ ID NO: 4885 - RNA, 17 nt, Homo sapiens
cagauggcugaggacaa

SEQ ID NO: 4886 - RNA, 17 nt, Homo sapiens
cugaggacaaggccucu

SEQ ID NO: 4887 - RNA, 17 nt, Homo sapiens
gacaaggccucugugaa

SEQ ID NO: 4888 - RNA, 17 nt, Homo sapiens
acaaggccucugugaaa

SEQ ID NO: 4889 - RNA, 17 nt, Homo sapiens
aaggccucugugaaagc

SEQ ID NO: 4890 - RNA, 17 nt, Homo sapiens
gugaaagcccaggugac

SEQ ID NO: 4891 - RNA, 17 nt, Homo sapiens
ugaaagcccaggugacg

SEQ ID NO: 4892 - RNA, 17 nt, Homo sapiens
gaaagcccaggugacgu

SEQ ID NO: 4893 - RNA, 17 nt, Homo sapiens
gugacguccuugcucgg

SEQ ID NO: 4894 - RNA, 17 nt, Homo sapiens
ugacguccuugcucggg

SEQ ID NO: 4895 - RNA, 17 nt, Homo sapiens
guccuugcucggggagc

SEQ ID NO: 4896 - RNA, 17 nt, Homo sapiens
cggggagcugcaggaga

SEQ ID NO: 4897 - RNA, 17 nt, Homo sapiens
ggagcugcaggagagcc

SEQ ID NO: 4898 - RNA, 17 nt, Homo sapiens
aggagagccagagucgc

SEQ ID NO: 4899 - RNA, 17 nt, Homo sapiens
ggagagccagagucgcu

SEQ ID NO: 4900 - RNA, 17 nt, Homo sapiens
agagucgcuuggaggcu

SEQ ID NO: 4901 - RNA, 17 nt, Homo sapiens
uuggaggcugccacuaa

SEQ ID NO: 4902 - RNA, 17 nt, Homo sapiens
gaggcugccacuaagga

SEQ ID NO: 4903 - RNA, 17 nt, Homo sapiens
aggcugccacuaaggaa

SEQ ID NO: 4904 - RNA, 17 nt, Homo sapiens
gcugccacuaaggaaug

SEQ ID NO: 4905 - RNA, 17 nt, Homo sapiens
aggaaugccaggcucug

SEQ ID NO: 4906 - RNA, 17 nt, Homo sapiens
ggaaugccaggcucugg

SEQ ID NO: 4907 - RNA, 17 nt, Homo sapiens
ugccaggcucuggaggg

SEQ ID NO: 4908 - RNA, 17 nt, Homo sapiens
ccaggcucuggaggguc

SEQ ID NO: 4909 - RNA, 17 nt, Homo sapiens
ggucgggcccgggcggc

SEQ ID NO: 4910 - RNA, 17 nt, Homo sapiens
gucgggcccgggcggcc

SEQ ID NO: 4911 - RNA, 17 nt, Homo sapiens
cgggcggccagcgagca

SEQ ID NO: 4912 - RNA, 17 nt, Homo sapiens
gggcggccagcgagcag

SEQ ID NO: 4913 - RNA, 17 nt, Homo sapiens
cagcgagcaggcgcggc

SEQ ID NO: 4914 - RNA, 17 nt, Homo sapiens
ggcgcggcagcuggaga

SEQ ID NO: 4915 - RNA, 17 nt, Homo sapiens
gcggcagcuggagagug

SEQ ID NO: 4916 - RNA, 17 nt, Homo sapiens
cgaggcgcugcagcagc

SEQ ID NO: 4917 - RNA, 17 nt, Homo sapiens
ggcgcugcagcagcagc

SEQ ID NO: 4918 - RNA, 17 nt, Homo sapiens
gcugcagcagcagcaca

SEQ ID NO: 4919 - RNA, 17 nt, Homo sapiens
gcagcagcagcacagcg

SEQ ID NO: 4920 - RNA, 17 nt, Homo sapiens
gcagcagcacagcgugc

SEQ ID NO: 4921 - RNA, 17 nt, Homo sapiens
agcagcacagcgugcag

SEQ ID NO: 4922 - RNA, 17 nt, Homo sapiens
cagcgugcagguggacc

SEQ ID NO: 4923 - RNA, 17 nt, Homo sapiens
agguggaccagcugcgc

SEQ ID NO: 4924 - RNA, 17 nt, Homo sapiens
gguggaccagcugcgca

SEQ ID NO: 4925 - RNA, 17 nt, Homo sapiens
ggaccagcugcgcaugc

SEQ ID NO: 4926 - RNA, 17 nt, Homo sapiens
agcugcgcaugcagggc

SEQ ID NO: 4927 - RNA, 17 nt, Homo sapiens
gcgcaugcagggccaga

SEQ ID NO: 4928 - RNA, 17 nt, Homo sapiens
ugcagggccagagcgug

SEQ ID NO: 4929 - RNA, 17 nt, Homo sapiens
gcagggccagagcgugg

SEQ ID NO: 4930 - RNA, 17 nt, Homo sapiens
guggaggccgcgcuccg

SEQ ID NO: 4931 - RNA, 17 nt, Homo sapiens
ggccgcgcuccgcaugg

SEQ ID NO: 4932 - RNA, 17 nt, Homo sapiens
ccgcgcuccgcauggag

SEQ ID NO: 4933 - RNA, 17 nt, Homo sapiens
cgcuccgcauggagcgc

SEQ ID NO: 4934 - RNA, 17 nt, Homo sapiens
uggagcgccaggccgcc

SEQ ID NO: 4935 - RNA, 17 nt, Homo sapiens
ggagcgccaggccgccu

SEQ ID NO: 4936 - RNA, 17 nt, Homo sapiens
cgccaggccgccucgga

SEQ ID NO: 4937 - RNA, 17 nt, Homo sapiens
caggccgccucggagga

SEQ ID NO: 4938 - RNA, 17 nt, Homo sapiens
aggccgccucggaggag

SEQ ID NO: 4939 - RNA, 17 nt, Homo sapiens
gaggaagcuggcccagu

SEQ ID NO: 4940 - RNA, 17 nt, Homo sapiens
aagcuggcccaguugca

SEQ ID NO: 4941 - RNA, 17 nt, Homo sapiens
agcuggcccaguugcag

SEQ ID NO: 4942 - RNA, 17 nt, Homo sapiens
gcuggcccaguugcagg

SEQ ID NO: 4943 - RNA, 17 nt, Homo sapiens
ccaguugcagguggccu

SEQ ID NO: 4944 - RNA, 17 nt, Homo sapiens
cagguggccuaucacca

SEQ ID NO: 4945 - RNA, 17 nt, Homo sapiens
agguggccuaucaccag

SEQ ID NO: 4946 - RNA, 17 nt, Homo sapiens
ggccuaucaccagcucu

SEQ ID NO: 4947 - RNA, 17 nt, Homo sapiens
ccuaucaccagcucuuc

SEQ ID NO: 4948 - RNA, 17 nt, Homo sapiens
cuaucaccagcucuucc

SEQ ID NO: 4949 - RNA, 17 nt, Homo sapiens
ucaccagcucuuccaag

SEQ ID NO: 4950 - RNA, 17 nt, Homo sapiens
accagcucuuccaagaa

SEQ ID NO: 4951 - RNA, 17 nt, Homo sapiens
agcucuuccaagaauac

SEQ ID NO: 4952 - RNA, 17 nt, Homo sapiens
gcucuuccaagaauacg

SEQ ID NO: 4953 - RNA, 17 nt, Homo sapiens
aauacgacaaccacauc

SEQ ID NO: 4954 - RNA, 17 nt, Homo sapiens
acgacaaccacaucaag

SEQ ID NO: 4955 - RNA, 17 nt, Homo sapiens
cgacaaccacaucaaga

SEQ ID NO: 4956 - RNA, 17 nt, Homo sapiens
acaaccacaucaagagc

SEQ ID NO: 4957 - RNA, 17 nt, Homo sapiens
accacaucaagagcagc

SEQ ID NO: 4958 - RNA, 17 nt, Homo sapiens
ucaagagcagcguggug

SEQ ID NO: 4959 - RNA, 17 nt, Homo sapiens
uggugggcagugagcgg

SEQ ID NO: 4960 - RNA, 17 nt, Homo sapiens
aggaaugcagcuggaag

SEQ ID NO: 4961 - RNA, 17 nt, Homo sapiens
aaugcagcuggaagauc

SEQ ID NO: 4962 - RNA, 17 nt, Homo sapiens
ggaagaucucaaacagc

SEQ ID NO: 4963 - RNA, 17 nt, Homo sapiens
aagaucucaaacagcag

SEQ ID NO: 4964 - RNA, 17 nt, Homo sapiens
ucucaaacagcagcucc

SEQ ID NO: 4965 - RNA, 17 nt, Homo sapiens
caaacagcagcuccagc

SEQ ID NO: 4966 - RNA, 17 nt, Homo sapiens
acagcagcuccagcagg

SEQ ID NO: 4967 - RNA, 17 nt, Homo sapiens
agcagcuccagcaggcc

SEQ ID NO: 4968 - RNA, 17 nt, Homo sapiens
gcagcuccagcaggccg

SEQ ID NO: 4969 - RNA, 17 nt, Homo sapiens
gcuccagcaggccgagg

SEQ ID NO: 4970 - RNA, 17 nt, Homo sapiens
cagcaggccgaggaggc

SEQ ID NO: 4971 - RNA, 17 nt, Homo sapiens
gaggaggcccugguggc

SEQ ID NO: 4972 - RNA, 17 nt, Homo sapiens
aggaggcccugguggcc

SEQ ID NO: 4973 - RNA, 17 nt, Homo sapiens
ggaggcccugguggcca

SEQ ID NO: 4974 - RNA, 17 nt, Homo sapiens
cugguggccaaacagga

SEQ ID NO: 4975 - RNA, 17 nt, Homo sapiens
ugguggccaaacaggag

SEQ ID NO: 4976 - RNA, 17 nt, Homo sapiens
ggccaaacaggagguga

SEQ ID NO: 4977 - RNA, 17 nt, Homo sapiens
cgauaagcugaaggagg

SEQ ID NO: 4978 - RNA, 17 nt, Homo sapiens
gaggaggccgagcagca

SEQ ID NO: 4979 - RNA, 17 nt, Homo sapiens
ggccgagcagcacaaga

SEQ ID NO: 4980 - RNA, 17 nt, Homo sapiens
cgagcagcacaagauug

SEQ ID NO: 4981 - RNA, 17 nt, Homo sapiens
agcagcacaagauugug

SEQ ID NO: 4982 - RNA, 17 nt, Homo sapiens
auggagaccguuccggu

SEQ ID NO: 4983 - RNA, 17 nt, Homo sapiens
gaccguuccggugcuga

SEQ ID NO: 4984 - RNA, 17 nt, Homo sapiens
uccggugcugaaggccc

SEQ ID NO: 4985 - RNA, 17 nt, Homo sapiens
cugaaggcccaggcgga

SEQ ID NO: 4986 - RNA, 17 nt, Homo sapiens
ugaaggcccaggcggau

SEQ ID NO: 4987 - RNA, 17 nt, Homo sapiens
gaaggcccaggcggaua

SEQ ID NO: 4988 - RNA, 17 nt, Homo sapiens
cggauaucuacaaggcg

SEQ ID NO: 4989 - RNA, 17 nt, Homo sapiens
auaucuacaaggcggac

SEQ ID NO: 4990 - RNA, 17 nt, Homo sapiens
aggcggacuuccaggcu

SEQ ID NO: 4991 - RNA, 17 nt, Homo sapiens
cggacuuccaggcugag

SEQ ID NO: 4992 - RNA, 17 nt, Homo sapiens
ggacuuccaggcugaga

SEQ ID NO: 4993 - RNA, 17 nt, Homo sapiens
uuccaggcugagaggca

SEQ ID NO: 4994 - RNA, 17 nt, Homo sapiens
ugagaggcaggcccggg

SEQ ID NO: 4995 - RNA, 17 nt, Homo sapiens
aggcaggcccgggagaa

SEQ ID NO: 4996 - RNA, 17 nt, Homo sapiens
ggcaggcccgggagaag

SEQ ID NO: 4997 - RNA, 17 nt, Homo sapiens
ggagaagcuggccgaga

SEQ ID NO: 4998 - RNA, 17 nt, Homo sapiens
aagcuggccgagaagaa

SEQ ID NO: 4999 - RNA, 17 nt, Homo sapiens
gaaggagcuccugcagg

SEQ ID NO: 5000 - RNA, 17 nt, Homo sapiens
aggagcuccugcaggag

SEQ ID NO: 5001 - RNA, 17 nt, Homo sapiens
ggagcuccugcaggagc

SEQ ID NO: 5002 - RNA, 17 nt, Homo sapiens
gcuccugcaggagcagc

SEQ ID NO: 5003 - RNA, 17 nt, Homo sapiens
gcaggagcagcuggagc

SEQ ID NO: 5004 - RNA, 17 nt, Homo sapiens
ggagcagcuggagcagc

SEQ ID NO: 5005 - RNA, 17 nt, Homo sapiens
gcuggagcagcugcaga

SEQ ID NO: 5006 - RNA, 17 nt, Homo sapiens
ggagcagcugcagaggg

SEQ ID NO: 5007 - RNA, 17 nt, Homo sapiens
gcagcugcagagggagu

SEQ ID NO: 5008 - RNA, 17 nt, Homo sapiens
gggaguacagcaaacug

SEQ ID NO: 5009 - RNA, 17 nt, Homo sapiens
aguacagcaaacugaag

SEQ ID NO: 5010 - RNA, 17 nt, Homo sapiens
cagcaaacugaaggcca

SEQ ID NO: 5011 - RNA, 17 nt, Homo sapiens
cugaaggccagcuguca

SEQ ID NO: 5012 - RNA, 17 nt, Homo sapiens
ugaaggccagcugucag

SEQ ID NO: 5013 - RNA, 17 nt, Homo sapiens
aggccagcugucaggag

SEQ ID NO: 5014 - RNA, 17 nt, Homo sapiens
cagcugucaggagucgg

SEQ ID NO: 5015 - RNA, 17 nt, Homo sapiens
gagucggccaggaucga

SEQ ID NO: 5016 - RNA, 17 nt, Homo sapiens
agucggccaggaucgag

SEQ ID NO: 5017 - RNA, 17 nt, Homo sapiens
ucgaggacaugaggaag

SEQ ID NO: 5018 - RNA, 17 nt, Homo sapiens
gaagcggcaugucgagg

SEQ ID NO: 5019 - RNA, 17 nt, Homo sapiens
ucgaggucucccaggcc

SEQ ID NO: 5020 - RNA, 17 nt, Homo sapiens
gaggucucccaggcccc

SEQ ID NO: 5021 - RNA, 17 nt, Homo sapiens
aggucucccaggccccc

SEQ ID NO: 5022 - RNA, 17 nt, Homo sapiens
ggucucccaggcccccu

SEQ ID NO: 5023 - RNA, 17 nt, Homo sapiens
ucccaggcccccuugcc

SEQ ID NO: 5024 - RNA, 17 nt, Homo sapiens
cccaggcccccuugccc

SEQ ID NO: 5025 - RNA, 17 nt, Homo sapiens
ccaggcccccuugcccc

SEQ ID NO: 5026 - RNA, 17 nt, Homo sapiens
caggcccccuugccccc

SEQ ID NO: 5027 - RNA, 17 nt, Homo sapiens
aggcccccuugcccccc

SEQ ID NO: 5028 - RNA, 17 nt, Homo sapiens
ccccuugccccccgccc

SEQ ID NO: 5029 - RNA, 17 nt, Homo sapiens
cccuugccccccgcccc

SEQ ID NO: 5030 - RNA, 17 nt, Homo sapiens
ccuugccccccgccccu

SEQ ID NO: 5031 - RNA, 17 nt, Homo sapiens
cuugccccccgccccug

SEQ ID NO: 5032 - RNA, 17 nt, Homo sapiens
uugccccccgccccugc

SEQ ID NO: 5033 - RNA, 17 nt, Homo sapiens
ccccccgccccugccua

SEQ ID NO: 5034 - RNA, 17 nt, Homo sapiens
cccccgccccugccuac

SEQ ID NO: 5035 - RNA, 17 nt, Homo sapiens
ccccgccccugccuacc

SEQ ID NO: 5036 - RNA, 17 nt, Homo sapiens
cccgccccugccuaccu

SEQ ID NO: 5037 - RNA, 17 nt, Homo sapiens
gccccugccuaccucuc

SEQ ID NO: 5038 - RNA, 17 nt, Homo sapiens
ccccugccuaccucucc

SEQ ID NO: 5039 - RNA, 17 nt, Homo sapiens
cugccuaccucuccucu

SEQ ID NO: 5040 - RNA, 17 nt, Homo sapiens
ugccuaccucuccucuc

SEQ ID NO: 5041 - RNA, 17 nt, Homo sapiens
ccuaccucuccucuccc

SEQ ID NO: 5042 - RNA, 17 nt, Homo sapiens
uaccucuccucuccccu

SEQ ID NO: 5043 - RNA, 17 nt, Homo sapiens
accucuccucuccccug

SEQ ID NO: 5044 - RNA, 17 nt, Homo sapiens
cucuccucuccccuggc

SEQ ID NO: 5045 - RNA, 17 nt, Homo sapiens
cuccucuccccuggccc

SEQ ID NO: 5046 - RNA, 17 nt, Homo sapiens
uccucuccccuggcccu

SEQ ID NO: 5047 - RNA, 17 nt, Homo sapiens
ccucuccccuggcccug

SEQ ID NO: 5048 - RNA, 17 nt, Homo sapiens
cucuccccuggcccugc

SEQ ID NO: 5049 - RNA, 17 nt, Homo sapiens
ccccuggcccugcccag

SEQ ID NO: 5050 - RNA, 17 nt, Homo sapiens
cccuggcccugcccagc

SEQ ID NO: 5051 - RNA, 17 nt, Homo sapiens
ccuggcccugcccagcc

SEQ ID NO: 5052 - RNA, 17 nt, Homo sapiens
ggcccugcccagccaga

SEQ ID NO: 5053 - RNA, 17 nt, Homo sapiens
gcccugcccagccagag

SEQ ID NO: 5054 - RNA, 17 nt, Homo sapiens
cccugcccagccagagg

SEQ ID NO: 5055 - RNA, 17 nt, Homo sapiens
ugcccagccagaggagg

SEQ ID NO: 5056 - RNA, 17 nt, Homo sapiens
gcccagccagaggagga

SEQ ID NO: 5057 - RNA, 17 nt, Homo sapiens
ggaggagcccccccgag

SEQ ID NO: 5058 - RNA, 17 nt, Homo sapiens
gaggagcccccccgagg

SEQ ID NO: 5059 - RNA, 17 nt, Homo sapiens
aggagcccccccgagga

SEQ ID NO: 5060 - RNA, 17 nt, Homo sapiens
ggagcccccccgaggag

SEQ ID NO: 5061 - RNA, 17 nt, Homo sapiens
gagcccccccgaggagc

SEQ ID NO: 5062 - RNA, 17 nt, Homo sapiens
agcccccccgaggagcc

SEQ ID NO: 5063 - RNA, 17 nt, Homo sapiens
cgaggagccaccugacu

SEQ ID NO: 5064 - RNA, 17 nt, Homo sapiens
gaggagccaccugacuu

SEQ ID NO: 5065 - RNA, 17 nt, Homo sapiens
ggagccaccugacuucu

SEQ ID NO: 5066 - RNA, 17 nt, Homo sapiens
gagccaccugacuucug

SEQ ID NO: 5067 - RNA, 17 nt, Homo sapiens
caccugacuucugcugu

SEQ ID NO: 5068 - RNA, 17 nt, Homo sapiens
cugacuucugcuguccc

SEQ ID NO: 5069 - RNA, 17 nt, Homo sapiens
acuucugcugucccaag

SEQ ID NO: 5070 - RNA, 17 nt, Homo sapiens
cugcugucccaagugcc

SEQ ID NO: 5071 - RNA, 17 nt, Homo sapiens
ugcugucccaagugcca

SEQ ID NO: 5072 - RNA, 17 nt, Homo sapiens
gcugucccaagugccag

SEQ ID NO: 5073 - RNA, 17 nt, Homo sapiens
ccaagugccaguaucag

SEQ ID NO: 5074 - RNA, 17 nt, Homo sapiens
caagugccaguaucagg

SEQ ID NO: 5075 - RNA, 17 nt, Homo sapiens
ccaguaucaggccccug

SEQ ID NO: 5076 - RNA, 17 nt, Homo sapiens
uaucaggccccugauau

SEQ ID NO: 5077 - RNA, 17 nt, Homo sapiens
aucaggccccugauaug

SEQ ID NO: 5078 - RNA, 17 nt, Homo sapiens
ucaggccccugauaugg

SEQ ID NO: 5079 - RNA, 17 nt, Homo sapiens
caggccccugauaugga

SEQ ID NO: 5080 - RNA, 17 nt, Homo sapiens
auauggacacccugcag

SEQ ID NO: 5081 - RNA, 17 nt, Homo sapiens
auggacacccugcagau

SEQ ID NO: 5082 - RNA, 17 nt, Homo sapiens
uggacacccugcagaua

SEQ ID NO: 5083 - RNA, 17 nt, Homo sapiens
ggacacccugcagauac

SEQ ID NO: 5084 - RNA, 17 nt, Homo sapiens
cacccugcagauacaug

SEQ ID NO: 5085 - RNA, 17 nt, Homo sapiens
gcagauacaugucaugg

SEQ ID NO: 5086 - RNA, 17 nt, Homo sapiens
uacaugucauggagugc

SEQ ID NO: 5087 - RNA, 17 nt, Homo sapiens
uggagugcauugaguag

SEQ ID NO: 5088 - RNA, 17 nt, Homo sapiens
aguagggccggccagug

SEQ ID NO: 5089 - RNA, 17 nt, Homo sapiens
gggccggccagugcaag

SEQ ID NO: 5090 - RNA, 17 nt, Homo sapiens
ggccggccagugcaagg

SEQ ID NO: 5091 - RNA, 17 nt, Homo sapiens
gccagugcaaggccacu

SEQ ID NO: 5092 - RNA, 17 nt, Homo sapiens
ugcaaggccacugccug

SEQ ID NO: 5093 - RNA, 17 nt, Homo sapiens
gcaaggccacugccugc

SEQ ID NO: 5094 - RNA, 17 nt, Homo sapiens
aaggccacugccugccc

SEQ ID NO: 5095 - RNA, 17 nt, Homo sapiens
gccacugccugcccgag

SEQ ID NO: 5096 - RNA, 17 nt, Homo sapiens
ccacugccugcccgagg

SEQ ID NO: 5097 - RNA, 17 nt, Homo sapiens
cugccugcccgaggacg

SEQ ID NO: 5098 - RNA, 17 nt, Homo sapiens
ugccugcccgaggacgu

SEQ ID NO: 5099 - RNA, 17 nt, Homo sapiens
ggacgugcccgggaccg

SEQ ID NO: 5100 - RNA, 17 nt, Homo sapiens
gacgugcccgggaccgu

SEQ ID NO: 5101 - RNA, 17 nt, Homo sapiens
cccgggaccgugcaguc

SEQ ID NO: 5102 - RNA, 17 nt, Homo sapiens
gaccgugcagucugcgc

SEQ ID NO: 5103 - RNA, 17 nt, Homo sapiens
gugcagucugcgcuuuc

SEQ ID NO: 5104 - RNA, 17 nt, Homo sapiens
gucugcgcuuuccucuc

SEQ ID NO: 5105 - RNA, 17 nt, Homo sapiens
gcgcuuuccucucccgc

SEQ ID NO: 5106 - RNA, 17 nt, Homo sapiens
cgcuuuccucucccgcc

SEQ ID NO: 5107 - RNA, 17 nt, Homo sapiens
cuuuccucucccgccug

SEQ ID NO: 5108 - RNA, 17 nt, Homo sapiens
uuccucucccgccugcc

SEQ ID NO: 5109 - RNA, 17 nt, Homo sapiens
uccucucccgccugccu

SEQ ID NO: 5110 - RNA, 17 nt, Homo sapiens
ucucccgccugccuagc

SEQ ID NO: 5111 - RNA, 17 nt, Homo sapiens
cucccgccugccuagcc

SEQ ID NO: 5112 - RNA, 17 nt, Homo sapiens
ccgccugccuagcccag

SEQ ID NO: 5113 - RNA, 17 nt, Homo sapiens
cgccugccuagcccagg

SEQ ID NO: 5114 - RNA, 17 nt, Homo sapiens
ugccuagcccaggauga

SEQ ID NO: 5115 - RNA, 17 nt, Homo sapiens
gccuagcccaggaugaa

SEQ ID NO: 5116 - RNA, 17 nt, Homo sapiens
ccuagcccaggaugaag

SEQ ID NO: 5117 - RNA, 17 nt, Homo sapiens
ugaagggcuggguggcc

SEQ ID NO: 5118 - RNA, 17 nt, Homo sapiens
uggguggccacaacugg

SEQ ID NO: 5119 - RNA, 17 nt, Homo sapiens
ggguggccacaacuggg

SEQ ID NO: 5120 - RNA, 17 nt, Homo sapiens
guggccacaacugggau

SEQ ID NO: 5121 - RNA, 17 nt, Homo sapiens
gccacaacugggaugcc

SEQ ID NO: 5122 - RNA, 17 nt, Homo sapiens
ugggaugccaccuggag

SEQ ID NO: 5123 - RNA, 17 nt, Homo sapiens
gggaugccaccuggagc

SEQ ID NO: 5124 - RNA, 17 nt, Homo sapiens
gaugccaccuggagccc

SEQ ID NO: 5125 - RNA, 17 nt, Homo sapiens
augccaccuggagcccc

SEQ ID NO: 5126 - RNA, 17 nt, Homo sapiens
ccuggagccccacccag

SEQ ID NO: 5127 - RNA, 17 nt, Homo sapiens
cuggagccccacccagg

SEQ ID NO: 5128 - RNA, 17 nt, Homo sapiens
uggagccccacccagga

SEQ ID NO: 5129 - RNA, 17 nt, Homo sapiens
ggagccccacccaggag

SEQ ID NO: 5130 - RNA, 17 nt, Homo sapiens
agccccacccaggagcu

SEQ ID NO: 5131 - RNA, 17 nt, Homo sapiens
gccccacccaggagcug

SEQ ID NO: 5132 - RNA, 17 nt, Homo sapiens
ccccacccaggagcugg

SEQ ID NO: 5133 - RNA, 17 nt, Homo sapiens
ccaggagcuggccgcgg

SEQ ID NO: 5134 - RNA, 17 nt, Homo sapiens
gagcuggccgcggcacc

SEQ ID NO: 5135 - RNA, 17 nt, Homo sapiens
gccgcggcaccuuacgc

SEQ ID NO: 5136 - RNA, 17 nt, Homo sapiens
cgcggcaccuuacgcuu

SEQ ID NO: 5137 - RNA, 17 nt, Homo sapiens
gcggcaccuuacgcuuc

SEQ ID NO: 5138 - RNA, 17 nt, Homo sapiens
ccuuacgcuucagcugu

SEQ ID NO: 5139 - RNA, 17 nt, Homo sapiens
uacgcuucagcuguuga

SEQ ID NO: 5140 - RNA, 17 nt, Homo sapiens
gcuucagcuguugaucc

SEQ ID NO: 5141 - RNA, 17 nt, Homo sapiens
uguugauccgcuggucc

SEQ ID NO: 5142 - RNA, 17 nt, Homo sapiens
ugauccgcugguccccu

SEQ ID NO: 5143 - RNA, 17 nt, Homo sapiens
cgcugguccccucuuuu

SEQ ID NO: 5144 - RNA, 17 nt, Homo sapiens
gcugguccccucuuuug

SEQ ID NO: 5145 - RNA, 17 nt, Homo sapiens
cugguccccucuuuugg

SEQ ID NO: 5146 - RNA, 17 nt, Homo sapiens
ugguccccucuuuuggg

SEQ ID NO: 5147 - RNA, 17 nt, Homo sapiens
guccccucuuuuggggu

SEQ ID NO: 5148 - RNA, 17 nt, Homo sapiens
gaugcggccccgaucag

SEQ ID NO: 5149 - RNA, 17 nt, Homo sapiens
augcggccccgaucagg

SEQ ID NO: 5150 - RNA, 17 nt, Homo sapiens
ugcggccccgaucaggc

SEQ ID NO: 5151 - RNA, 17 nt, Homo sapiens
ccccgaucaggccugac

SEQ ID NO: 5152 - RNA, 17 nt, Homo sapiens
gaucaggccugacucgc

SEQ ID NO: 5153 - RNA, 17 nt, Homo sapiens
aucaggccugacucgcu

SEQ ID NO: 5154 - RNA, 17 nt, Homo sapiens
ggccugacucgcugcuc

SEQ ID NO: 5155 - RNA, 17 nt, Homo sapiens
ugacucgcugcucuuuu

SEQ ID NO: 5156 - RNA, 17 nt, Homo sapiens
cucgcugcucuuuuugu

SEQ ID NO: 5157 - RNA, 17 nt, Homo sapiens
cgcugcucuuuuuguuc

SEQ ID NO: 5158 - RNA, 17 nt, Homo sapiens
uuuuguucccuucuguc

SEQ ID NO: 5159 - RNA, 17 nt, Homo sapiens
uuuguucccuucugucu

SEQ ID NO: 5160 - RNA, 17 nt, Homo sapiens
uuguucccuucugucug

SEQ ID NO: 5161 - RNA, 17 nt, Homo sapiens
uucccuucugucugcuc

SEQ ID NO: 5162 - RNA, 17 nt, Homo sapiens
cuucugucugcucgaac

SEQ ID NO: 5163 - RNA, 17 nt, Homo sapiens
cugucugcucgaaccac

SEQ ID NO: 5164 - RNA, 17 nt, Homo sapiens
gcucgaaccacuugccu

SEQ ID NO: 5165 - RNA, 17 nt, Homo sapiens
cucgaaccacuugccuc

SEQ ID NO: 5166 - RNA, 17 nt, Homo sapiens
cgaaccacuugccucgg

SEQ ID NO: 5167 - RNA, 17 nt, Homo sapiens
ccacuugccucgggcua

SEQ ID NO: 5168 - RNA, 17 nt, Homo sapiens
cacuugccucgggcuaa

SEQ ID NO: 5169 - RNA, 17 nt, Homo sapiens
ccucgggcuaaucccuc

SEQ ID NO: 5170 - RNA, 17 nt, Homo sapiens
ggcuaaucccucccucu

SEQ ID NO: 5171 - RNA, 17 nt, Homo sapiens
gcuaaucccucccucuu

SEQ ID NO: 5172 - RNA, 17 nt, Homo sapiens
cuaaucccucccucuuc

SEQ ID NO: 5173 - RNA, 17 nt, Homo sapiens
aaucccucccucuuccu

SEQ ID NO: 5174 - RNA, 17 nt, Homo sapiens
aucccucccucuuccuc

SEQ ID NO: 5175 - RNA, 17 nt, Homo sapiens
ucccucccucuuccucc

SEQ ID NO: 5176 - RNA, 17 nt, Homo sapiens
ccucccucuuccuccac

SEQ ID NO: 5177 - RNA, 17 nt, Homo sapiens
cccucuuccuccacccg

SEQ ID NO: 5178 - RNA, 17 nt, Homo sapiens
ccucuuccuccacccgg

SEQ ID NO: 5179 - RNA, 17 nt, Homo sapiens
ucuuccuccacccggca

SEQ ID NO: 5180 - RNA, 17 nt, Homo sapiens
cuuccuccacccggcac

SEQ ID NO: 5181 - RNA, 17 nt, Homo sapiens
uccuccacccggcacug

SEQ ID NO: 5182 - RNA, 17 nt, Homo sapiens
ccuccacccggcacugg

SEQ ID NO: 5183 - RNA, 17 nt, Homo sapiens
cacccggcacuggggaa

SEQ ID NO: 5184 - RNA, 17 nt, Homo sapiens
cccggcacuggggaagu

SEQ ID NO: 5185 - RNA, 17 nt, Homo sapiens
gggaagucaagaauggg

SEQ ID NO: 5186 - RNA, 17 nt, Homo sapiens
aauggggccuggggcuc

SEQ ID NO: 5187 - RNA, 17 nt, Homo sapiens
auggggccuggggcucu

SEQ ID NO: 5188 - RNA, 17 nt, Homo sapiens
ccuggggcucucaggga

SEQ ID NO: 5189 - RNA, 17 nt, Homo sapiens
uggggcucucagggaga

SEQ ID NO: 5190 - RNA, 17 nt, Homo sapiens
gggcucucagggagaac

SEQ ID NO: 5191 - RNA, 17 nt, Homo sapiens
gggagaacugcuucccc

SEQ ID NO: 5192 - RNA, 17 nt, Homo sapiens
agaacugcuuccccugg

SEQ ID NO: 5193 - RNA, 17 nt, Homo sapiens
acugcuuccccuggcag

SEQ ID NO: 5194 - RNA, 17 nt, Homo sapiens
cugcuuccccuggcaga

SEQ ID NO: 5195 - RNA, 17 nt, Homo sapiens
ugcuuccccuggcagag

SEQ ID NO: 5196 - RNA, 17 nt, Homo sapiens
gcuuccccuggcagagc

SEQ ID NO: 5197 - RNA, 17 nt, Homo sapiens
ccccuggcagagcuggg

SEQ ID NO: 5198 - RNA, 17 nt, Homo sapiens
ggcagagcuggguggca

SEQ ID NO: 5199 - RNA, 17 nt, Homo sapiens
uggguggcagcucuucc

SEQ ID NO: 5200 - RNA, 17 nt, Homo sapiens
guggcagcucuuccucc

SEQ ID NO: 5201 - RNA, 17 nt, Homo sapiens
ggcagcucuuccuccca

SEQ ID NO: 5202 - RNA, 17 nt, Homo sapiens
agcucuuccucccaccg

SEQ ID NO: 5203 - RNA, 17 nt, Homo sapiens
gcucuuccucccaccgg

SEQ ID NO: 5204 - RNA, 17 nt, Homo sapiens
ucuuccucccaccggac

SEQ ID NO: 5205 - RNA, 17 nt, Homo sapiens
cuuccucccaccggaca

SEQ ID NO: 5206 - RNA, 17 nt, Homo sapiens
uuccucccaccggacac

SEQ ID NO: 5207 - RNA, 17 nt, Homo sapiens
ccucccaccggacaccg

SEQ ID NO: 5208 - RNA, 17 nt, Homo sapiens
caccggacaccgacccg

SEQ ID NO: 5209 - RNA, 17 nt, Homo sapiens
ccggacaccgacccgcc

SEQ ID NO: 5210 - RNA, 17 nt, Homo sapiens
acaccgacccgcccgcc

SEQ ID NO: 5211 - RNA, 17 nt, Homo sapiens
caccgacccgcccgccg

SEQ ID NO: 5212 - RNA, 17 nt, Homo sapiens
cgacccgcccgccgcug

SEQ ID NO: 5213 - RNA, 17 nt, Homo sapiens
gacccgcccgccgcugu

SEQ ID NO: 5214 - RNA, 17 nt, Homo sapiens
ccgcccgccgcugugcc

SEQ ID NO: 5215 - RNA, 17 nt, Homo sapiens
cccgccgcugugcccug

SEQ ID NO: 5216 - RNA, 17 nt, Homo sapiens
cgcugugcccugggagu

SEQ ID NO: 5217 - RNA, 17 nt, Homo sapiens
gcugugcccugggagug

SEQ ID NO: 5218 - RNA, 17 nt, Homo sapiens
cugugcccugggagugc

SEQ ID NO: 5219 - RNA, 17 nt, Homo sapiens
gggagugcugcccucuu

SEQ ID NO: 5220 - RNA, 17 nt, Homo sapiens
agugcugcccucuuacc

SEQ ID NO: 5221 - RNA, 17 nt, Homo sapiens
gugcugcccucuuacca

SEQ ID NO: 5222 - RNA, 17 nt, Homo sapiens
ugcugcccucuuaccau

SEQ ID NO: 5223 - RNA, 17 nt, Homo sapiens
cugcccucuuaccaugc

SEQ ID NO: 5224 - RNA, 17 nt, Homo sapiens
ccucuuaccaugcacac

SEQ ID NO: 5225 - RNA, 17 nt, Homo sapiens
cucuuaccaugcacacg

SEQ ID NO: 5226 - RNA, 17 nt, Homo sapiens
uaccaugcacacgggug

SEQ ID NO: 5227 - RNA, 17 nt, Homo sapiens
ccaugcacacgggugcu

SEQ ID NO: 5228 - RNA, 17 nt, Homo sapiens
acgggugcucuccuuuu

SEQ ID NO: 5229 - RNA, 17 nt, Homo sapiens
gggugcucuccuuuugg

SEQ ID NO: 5230 - RNA, 17 nt, Homo sapiens
gugcucuccuuuugggc

SEQ ID NO: 5231 - RNA, 17 nt, Homo sapiens
ugcucuccuuuugggcu

SEQ ID NO: 5232 - RNA, 17 nt, Homo sapiens
uuuugggcugcaugcua

SEQ ID NO: 5233 - RNA, 17 nt, Homo sapiens
ugggcugcaugcuauuc

SEQ ID NO: 5234 - RNA, 17 nt, Homo sapiens
cugcaugcuauuccauu

SEQ ID NO: 5235 - RNA, 17 nt, Homo sapiens
ugcuauuccauuuugca

SEQ ID NO: 5236 - RNA, 17 nt, Homo sapiens
gcuauuccauuuugcag

SEQ ID NO: 5237 - RNA, 17 nt, Homo sapiens
cauuuugcagccagacc

SEQ ID NO: 5238 - RNA, 17 nt, Homo sapiens
uuugcagccagaccgau

SEQ ID NO: 5239 - RNA, 17 nt, Homo sapiens
uugcagccagaccgaug

SEQ ID NO: 5240 - RNA, 17 nt, Homo sapiens
agccagaccgaugugua

SEQ ID NO: 5241 - RNA, 17 nt, Homo sapiens
uauuuaaccagucacua

SEQ ID NO: 5242 - RNA, 17 nt, Homo sapiens
auuuaaccagucacuau

SEQ ID NO: 5243 - RNA, 17 nt, Homo sapiens
aaccagucacuauugau

SEQ ID NO: 5244 - RNA, 17 nt, Homo sapiens
ccagucacuauugaugg

SEQ ID NO: 5245 - RNA, 17 nt, Homo sapiens
ugauggacauuuggguu

SEQ ID NO: 5246 - RNA, 17 nt, Homo sapiens
guuguuucccaucuuuu

SEQ ID NO: 5247 - RNA, 17 nt, Homo sapiens
uuguuucccaucuuuuu

SEQ ID NO: 5248 - RNA, 17 nt, Homo sapiens
uguuucccaucuuuuug

SEQ ID NO: 5249 - RNA, 17 nt, Homo sapiens
uucccaucuuuuuguua

SEQ ID NO: 5250 - RNA, 17 nt, Homo sapiens
uuuguuaccauaaauaa

SEQ ID NO: 5251 - RNA, 17 nt, Homo sapiens
uuguuaccauaaauaau

SEQ ID NO: 5252 - RNA, 17 nt, Homo sapiens
auaauggcauaguaaaa

SEQ ID NO: 5253 - RNA, 38 nt, Artificial Sequence
  Description of Artificial Sequence:  Enzymatic Nucleic Acid
  misc_feature (31)..(31): n stands for inosine
aagggccacugaugaggccguuaggccgaancucgugc

SEQ ID NO: 5254 - RNA, 38 nt, Artificial Sequence
  Description of Artificial Sequence:  Enzymatic Nucleic Acid
  misc_feature (31)..(31): n stands for inosine
aucacaagcugaugaggccguuaggccgaanccaugcu

SEQ ID NO: 5255 - RNA, 38 nt, Artificial Sequence
  Description of Artificial Sequence:  Enzymatic Nucleic Acid
  misc_feature (31)..(31): n stands for inosine
gaucacaacugaugaggccguuaggccgaangccaugc

SEQ ID NO: 5256 - RNA, 38 nt, Artificial Sequence
  Description of Artificial Sequence:  Enzymatic Nucleic Acid
  misc_feature (31)..(31): n stands for inosine
ggaucacacugaugaggccguuaggccgaanggccaug

SEQ ID NO: 5257 - RNA, 38 nt, Artificial Sequence
  Description of Artificial Sequence:  Enzymatic Nucleic Acid
  misc_feature (31)..(31): n stands for inosine
ccccaccucugaugaggccguuaggccgaanaucacaa

SEQ ID NO: 5258 - RNA, 38 nt, Artificial Sequence
  Description of Artificial Sequence:  Enzymatic Nucleic Acid
  misc_feature (31)..(31): n stands for inosine
uccccacccugaugaggccguuaggccgaangaucaca

SEQ ID NO: 5259 - RNA, 38 nt, Artificial Sequence
  Description of Artificial Sequence:  Enzymatic Nucleic Acid
  misc_feature (31)..(31): n stands for inosine
ugggccuucugaugaggccguuaggccgaanuuucccc

SEQ ID NO: 5260 - RNA, 38 nt, Artificial Sequence
  Description of Artificial Sequence:  Enzymatic Nucleic Acid
  misc_feature (31)..(31): n stands for inosine
cuucucugcugaugaggccguuaggccgaanccuuagu

SEQ ID NO: 5261 - RNA, 38 nt, Artificial Sequence
  Description of Artificial Sequence:  Enzymatic Nucleic Acid
  misc_feature (31)..(31): n stands for inosine
acuucucucugaugaggccguuaggccgaangccuuag

SEQ ID NO: 5262 - RNA, 38 nt, Artificial Sequence
  Description of Artificial Sequence:  Enzymatic Nucleic Acid
  misc_feature (31)..(31): n stands for inosine
cacuucuccugaugaggccguuaggccgaanggccuua

SEQ ID NO: 5263 - RNA, 38 nt, Artificial Sequence
  Description of Artificial Sequence:  Enzymatic Nucleic Acid
  misc_feature (31)..(31): n stands for inosine
gucugcggcugaugaggccguuaggccgaanuccucac

SEQ ID NO: 5264 - RNA, 38 nt, Artificial Sequence
  Description of Artificial Sequence:  Enzymatic Nucleic Acid
  misc_feature (31)..(31): n stands for inosine
agucugcgcugaugaggccguuaggccgaanguccuca

SEQ ID NO: 5265 - RNA, 38 nt, Artificial Sequence
  Description of Artificial Sequence:  Enzymatic Nucleic Acid
  misc_feature (31)..(31): n stands for inosine
uagucugccugaugaggccguuaggccgaangguccuc

SEQ ID NO: 5266 - RNA, 38 nt, Artificial Sequence
  Description of Artificial Sequence:  Enzymatic Nucleic Acid
  misc_feature (31)..(31): n stands for inosine
ugauaguccugaugaggccguuaggccgaancgggguc

SEQ ID NO: 5267 - RNA, 38 nt, Artificial Sequence
  Description of Artificial Sequence:  Enzymatic Nucleic Acid
  misc_feature (31)..(31): n stands for inosine
ggauugaucugaugaggccguuaggccgaanucugcgg

SEQ ID NO: 5268 - RNA, 38 nt, Artificial Sequence
  Description of Artificial Sequence:  Enzymatic Nucleic Acid
  misc_feature (31)..(31): n stands for inosine
acugggaucugaugaggccguuaggccgaanauagucu

SEQ ID NO: 5269 - RNA, 38 nt, Artificial Sequence
  Description of Artificial Sequence:  Enzymatic Nucleic Acid
  misc_feature (31)..(31): n stands for inosine
agagacugcugaugaggccguuaggccgaanauugaua

SEQ ID NO: 5270 - RNA, 38 nt, Artificial Sequence
  Description of Artificial Sequence:  Enzymatic Nucleic Acid
  misc_feature (31)..(31): n stands for inosine
aagagacucugaugaggccguuaggccgaangauugau

SEQ ID NO: 5271 - RNA, 38 nt, Artificial Sequence
  Description of Artificial Sequence:  Enzymatic Nucleic Acid
  misc_feature (31)..(31): n stands for inosine
gaagagaccugaugaggccguuaggccgaanggauuga

SEQ ID NO: 5272 - RNA, 38 nt, Artificial Sequence
  Description of Artificial Sequence:  Enzymatic Nucleic Acid
  misc_feature (31)..(31): n stands for inosine
aggggaagcugaugaggccguuaggccgaanacuggga

SEQ ID NO: 5273 - RNA, 38 nt, Artificial Sequence
  Description of Artificial Sequence:  Enzymatic Nucleic Acid
  misc_feature (31)..(31): n stands for inosine
ugaggggacugaugaggccguuaggccgaanagacugg

SEQ ID NO: 5274 - RNA, 38 nt, Artificial Sequence
  Description of Artificial Sequence:  Enzymatic Nucleic Acid
  misc_feature (31)..(31): n stands for inosine
gagugaggcugaugaggccguuaggccgaanaagagac

SEQ ID NO: 5275 - RNA, 38 nt, Artificial Sequence
  Description of Artificial Sequence:  Enzymatic Nucleic Acid
  misc_feature (31)..(31): n stands for inosine
ggagugagcugaugaggccguuaggccgaangaagaga

SEQ ID NO: 5276 - RNA, 38 nt, Artificial Sequence
  Description of Artificial Sequence:  Enzymatic Nucleic Acid
  misc_feature (31)..(31): n stands for inosine
gggagugacugaugaggccguuaggccgaanggaagag

SEQ ID NO: 5277 - RNA, 38 nt, Artificial Sequence
  Description of Artificial Sequence:  Enzymatic Nucleic Acid
  misc_feature (31)..(31): n stands for inosine
agggagugcugaugaggccguuaggccgaangggaaga

SEQ ID NO: 5278 - RNA, 38 nt, Artificial Sequence
  Description of Artificial Sequence:  Enzymatic Nucleic Acid
  misc_feature (31)..(31): n stands for inosine
acagggagcugaugaggccguuaggccgaanaggggaa

SEQ ID NO: 5279 - RNA, 38 nt, Artificial Sequence
  Description of Artificial Sequence:  Enzymatic Nucleic Acid
  misc_feature (31)..(31): n stands for inosine
ucacagggcugaugaggccguuaggccgaanugagggg

SEQ ID NO: 5280 - RNA, 38 nt, Artificial Sequence
  Description of Artificial Sequence:  Enzymatic Nucleic Acid
  misc_feature (31)..(31): n stands for inosine
cuucacagcugaugaggccguuaggccgaanagugagg

SEQ ID NO: 5281 - RNA, 38 nt, Artificial Sequence
  Description of Artificial Sequence:  Enzymatic Nucleic Acid
  misc_feature (31)..(31): n stands for inosine
gcuucacacugaugaggccguuaggccgaangagugag

SEQ ID NO: 5282 - RNA, 38 nt, Artificial Sequence
  Description of Artificial Sequence:  Enzymatic Nucleic Acid
  misc_feature (31)..(31): n stands for inosine
agcuucaccugaugaggccguuaggccgaanggaguga

SEQ ID NO: 5283 - RNA, 38 nt, Artificial Sequence
  Description of Artificial Sequence:  Enzymatic Nucleic Acid
  misc_feature (31)..(31): n stands for inosine
ugcuggagcugaugaggccguuaggccgaancuucaca

SEQ ID NO: 5284 - RNA, 38 nt, Artificial Sequence
  Description of Artificial Sequence:  Enzymatic Nucleic Acid
  misc_feature (31)..(31): n stands for inosine
gaugcuggcugaugaggccguuaggccgaanagcuuca

SEQ ID NO: 5285 - RNA, 38 nt, Artificial Sequence
  Description of Artificial Sequence:  Enzymatic Nucleic Acid
  misc_feature (31)..(31): n stands for inosine
augaugcucugaugaggccguuaggccgaanagagcuu

SEQ ID NO: 5286 - RNA, 38 nt, Artificial Sequence
  Description of Artificial Sequence:  Enzymatic Nucleic Acid
  misc_feature (31)..(31): n stands for inosine
gaugaugccugaugaggccguuaggccgaangagagcu

SEQ ID NO: 5287 - RNA, 38 nt, Artificial Sequence
  Description of Artificial Sequence:  Enzymatic Nucleic Acid
  misc_feature (31)..(31): n stands for inosine
cucgaugacugaugaggccguuaggccgaancuggaga

SEQ ID NO: 5288 - RNA, 38 nt, Artificial Sequence
  Description of Artificial Sequence:  Enzymatic Nucleic Acid
  misc_feature (31)..(31): n stands for inosine
gaccucgacugaugaggccguuaggccgaanaugcugg

SEQ ID NO: 5289 - RNA, 38 nt, Artificial Sequence
  Description of Artificial Sequence:  Enzymatic Nucleic Acid
  misc_feature (31)..(31): n stands for inosine
ggcugaugcugaugaggccguuaggccgaanaccucga

SEQ ID NO: 5290 - RNA, 38 nt, Artificial Sequence
  Description of Artificial Sequence:  Enzymatic Nucleic Acid
  misc_feature (31)..(31): n stands for inosine
gggcugaucugaugaggccguuaggccgaangaccucg

SEQ ID NO: 5291 - RNA, 38 nt, Artificial Sequence
  Description of Artificial Sequence:  Enzymatic Nucleic Acid
  misc_feature (31)..(31): n stands for inosine
agggcugacugaugaggccguuaggccgaanggaccuc

SEQ ID NO: 5292 - RNA, 38 nt, Artificial Sequence
  Description of Artificial Sequence:  Enzymatic Nucleic Acid
  misc_feature (31)..(31): n stands for inosine
gcaagggccugaugaggccguuaggccgaanaugggac

SEQ ID NO: 5293 - RNA, 38 nt, Artificial Sequence
  Description of Artificial Sequence:  Enzymatic Nucleic Acid
  misc_feature (31)..(31): n stands for inosine
agggcaagcugaugaggccguuaggccgaancugaugg

SEQ ID NO: 5294 - RNA, 38 nt, Artificial Sequence
  Description of Artificial Sequence:  Enzymatic Nucleic Acid
  misc_feature (31)..(31): n stands for inosine
cagggcaacugaugaggccguuaggccgaangcugaug

SEQ ID NO: 5295 - RNA, 38 nt, Artificial Sequence
  Description of Artificial Sequence:  Enzymatic Nucleic Acid
  misc_feature (31)..(31): n stands for inosine
acagggcacugaugaggccguuaggccgaanggcugau

SEQ ID NO: 5296 - RNA, 38 nt, Artificial Sequence
  Description of Artificial Sequence:  Enzymatic Nucleic Acid
  misc_feature (31)..(31): n stands for inosine
uccaacagcugaugaggccguuaggccgaancaagggc

SEQ ID NO: 5297 - RNA, 38 nt, Artificial Sequence
  Description of Artificial Sequence:  Enzymatic Nucleic Acid
  misc_feature (31)..(31): n stands for inosine
auccaacacugaugaggccguuaggccgaangcaaggg

SEQ ID NO: 5298 - RNA, 38 nt, Artificial Sequence
  Description of Artificial Sequence:  Enzymatic Nucleic Acid
  misc_feature (31)..(31): n stands for inosine
cauccaaccugaugaggccguuaggccgaanggcaagg

SEQ ID NO: 5299 - RNA, 38 nt, Artificial Sequence
  Description of Artificial Sequence:  Enzymatic Nucleic Acid
  misc_feature (31)..(31): n stands for inosine
uccagaggcugaugaggccguuaggccgaanccuauuc

SEQ ID NO: 5300 - RNA, 38 nt, Artificial Sequence
  Description of Artificial Sequence:  Enzymatic Nucleic Acid
  misc_feature (31)..(31): n stands for inosine
cuuccagacugaugaggccguuaggccgaanugccuau

SEQ ID NO: 5301 - RNA, 38 nt, Artificial Sequence
  Description of Artificial Sequence:  Enzymatic Nucleic Acid
  misc_feature (31)..(31): n stands for inosine
ucuuccagcugaugaggccguuaggccgaangugccua

SEQ ID NO: 5302 - RNA, 38 nt, Artificial Sequence
  Description of Artificial Sequence:  Enzymatic Nucleic Acid
  misc_feature (31)..(31): n stands for inosine
gcucuucccugaugaggccguuaggccgaanaggugcc

SEQ ID NO: 5303 - RNA, 38 nt, Artificial Sequence
  Description of Artificial Sequence:  Enzymatic Nucleic Acid
  misc_feature (31)..(31): n stands for inosine
acacaguucugaugaggccguuaggccgaancucuucc

SEQ ID NO: 5304 - RNA, 38 nt, Artificial Sequence
  Description of Artificial Sequence:  Enzymatic Nucleic Acid
  misc_feature (31)..(31): n stands for inosine
cacacagucugaugaggccguuaggccgaangcucuuc

SEQ ID NO: 5305 - RNA, 38 nt, Artificial Sequence
  Description of Artificial Sequence:  Enzymatic Nucleic Acid
  misc_feature (31)..(31): n stands for inosine
ucucacaccugaugaggccguuaggccgaanuuggcuc

SEQ ID NO: 5306 - RNA, 38 nt, Artificial Sequence
  Description of Artificial Sequence:  Enzymatic Nucleic Acid
  misc_feature (31)..(31): n stands for inosine
cacugggccugaugaggccguuaggccgaancaccauc

SEQ ID NO: 5307 - RNA, 38 nt, Artificial Sequence
  Description of Artificial Sequence:  Enzymatic Nucleic Acid
  misc_feature (31)..(31): n stands for inosine
caccacugcugaugaggccguuaggccgaancugcacc

SEQ ID NO: 5308 - RNA, 38 nt, Artificial Sequence
  Description of Artificial Sequence:  Enzymatic Nucleic Acid
  misc_feature (31)..(31): n stands for inosine
ccaccacucugaugaggccguuaggccgaangcugcac

SEQ ID NO: 5309 - RNA, 38 nt, Artificial Sequence
  Description of Artificial Sequence:  Enzymatic Nucleic Acid
  misc_feature (31)..(31): n stands for inosine
gccaccaccugaugaggccguuaggccgaanggcugca

SEQ ID NO: 5310 - RNA, 38 nt, Artificial Sequence
  Description of Artificial Sequence:  Enzymatic Nucleic Acid
  misc_feature (31)..(31): n stands for inosine
ugcugccgcugaugaggccguuaggccgaanccaccac

SEQ ID NO: 5311 - RNA, 38 nt, Artificial Sequence
  Description of Artificial Sequence:  Enzymatic Nucleic Acid
  misc_feature (31)..(31): n stands for inosine
cugcugcccugaugaggccguuaggccgaangccacca

SEQ ID NO: 5312 - RNA, 38 nt, Artificial Sequence
  Description of Artificial Sequence:  Enzymatic Nucleic Acid
  misc_feature (31)..(31): n stands for inosine
ugaucugccugaugaggccguuaggccgaanccgggcc

SEQ ID NO: 5313 - RNA, 38 nt, Artificial Sequence
  Description of Artificial Sequence:  Enzymatic Nucleic Acid
  misc_feature (31)..(31): n stands for inosine
uccugauccugaugaggccguuaggccgaancugccgg

SEQ ID NO: 5314 - RNA, 38 nt, Artificial Sequence
  Description of Artificial Sequence:  Enzymatic Nucleic Acid
  misc_feature (31)..(31): n stands for inosine
guacgucccugaugaggccguuaggccgaanaucugcu

SEQ ID NO: 5315 - RNA, 38 nt, Artificial Sequence
  Description of Artificial Sequence:  Enzymatic Nucleic Acid
  misc_feature (31)..(31): n stands for inosine
cuucgccccugaugaggccguuaggccgaanuacgucc

SEQ ID NO: 5316 - RNA, 38 nt, Artificial Sequence
  Description of Artificial Sequence:  Enzymatic Nucleic Acid
  misc_feature (31)..(31): n stands for inosine
cccagaggcugaugaggccguuaggccgaanacucuuc

SEQ ID NO: 5317 - RNA, 38 nt, Artificial Sequence
  Description of Artificial Sequence:  Enzymatic Nucleic Acid
  misc_feature (31)..(31): n stands for inosine
uccccagacugaugaggccguuaggccgaanagacucu

SEQ ID NO: 5318 - RNA, 38 nt, Artificial Sequence
  Description of Artificial Sequence:  Enzymatic Nucleic Acid
  misc_feature (31)..(31): n stands for inosine
uuccccagcugaugaggccguuaggccgaangagacuc

SEQ ID NO: 5319 - RNA, 38 nt, Artificial Sequence
  Description of Artificial Sequence:  Enzymatic Nucleic Acid
  misc_feature (31)..(31): n stands for inosine
gcuucccccugaugaggccguuaggccgaanaggagac

SEQ ID NO: 5320 - RNA, 38 nt, Artificial Sequence
  Description of Artificial Sequence:  Enzymatic Nucleic Acid
  misc_feature (31)..(31): n stands for inosine
gcauggcucugaugaggccguuaggccgaancuucccc

SEQ ID NO: 5321 - RNA, 38 nt, Artificial Sequence
  Description of Artificial Sequence:  Enzymatic Nucleic Acid
  misc_feature (31)..(31): n stands for inosine
agcauggccugaugaggccguuaggccgaangcuuccc

SEQ ID NO: 5322 - RNA, 38 nt, Artificial Sequence
  Description of Artificial Sequence:  Enzymatic Nucleic Acid
  misc_feature (31)..(31): n stands for inosine
ugcagcaucugaugaggccguuaggccgaancuggcuu

SEQ ID NO: 5323 - RNA, 38 nt, Artificial Sequence
  Description of Artificial Sequence:  Enzymatic Nucleic Acid
  misc_feature (31)..(31): n stands for inosine
gugcagcacugaugaggccguuaggccgaangcuggcu

SEQ ID NO: 5324 - RNA, 38 nt, Artificial Sequence
  Description of Artificial Sequence:  Enzymatic Nucleic Acid
  misc_feature (31)..(31): n stands for inosine
gcaggugccugaugaggccguuaggccgaancauggcu

SEQ ID NO: 5325 - RNA, 38 nt, Artificial Sequence
  Description of Artificial Sequence:  Enzymatic Nucleic Acid
  misc_feature (31)..(31): n stands for inosine
aaggcaggcugaugaggccguuaggccgaancagcaug

SEQ ID NO: 5326 - RNA, 38 nt, Artificial Sequence
  Description of Artificial Sequence:  Enzymatic Nucleic Acid
  misc_feature (31)..(31): n stands for inosine
ugaaggcacugaugaggccguuaggccgaanugcagca

SEQ ID NO: 5327 - RNA, 38 nt, Artificial Sequence
  Description of Artificial Sequence:  Enzymatic Nucleic Acid
  misc_feature (31)..(31): n stands for inosine
cugaaggccugaugaggccguuaggccgaangugcagc

SEQ ID NO: 5328 - RNA, 38 nt, Artificial Sequence
  Description of Artificial Sequence:  Enzymatic Nucleic Acid
  misc_feature (31)..(31): n stands for inosine
guucugaacugaugaggccguuaggccgaancaggugc

SEQ ID NO: 5329 - RNA, 38 nt, Artificial Sequence
  Description of Artificial Sequence:  Enzymatic Nucleic Acid
  misc_feature (31)..(31): n stands for inosine
uguucugacugaugaggccguuaggccgaangcaggug

SEQ ID NO: 5330 - RNA, 38 nt, Artificial Sequence
  Description of Artificial Sequence:  Enzymatic Nucleic Acid
  misc_feature (31)..(31): n stands for inosine
cccuguuccugaugaggccguuaggccgaanaaggcag

SEQ ID NO: 5331 - RNA, 38 nt, Artificial Sequence
  Description of Artificial Sequence:  Enzymatic Nucleic Acid
  misc_feature (31)..(31): n stands for inosine
gagcgccccugaugaggccguuaggccgaanuucugaa

SEQ ID NO: 5332 - RNA, 38 nt, Artificial Sequence
  Description of Artificial Sequence:  Enzymatic Nucleic Acid
  misc_feature (31)..(31): n stands for inosine
gucucaggcugaugaggccguuaggccgaancgcccug

SEQ ID NO: 5333 - RNA, 38 nt, Artificial Sequence
  Description of Artificial Sequence:  Enzymatic Nucleic Acid
  misc_feature (31)..(31): n stands for inosine
gggucucacugaugaggccguuaggccgaanagcgccc

SEQ ID NO: 5334 - RNA, 38 nt, Artificial Sequence
  Description of Artificial Sequence:  Enzymatic Nucleic Acid
  misc_feature (31)..(31): n stands for inosine
agggucuccugaugaggccguuaggccgaangagcgcc

SEQ ID NO: 5335 - RNA, 38 nt, Artificial Sequence
  Description of Artificial Sequence:  Enzymatic Nucleic Acid
  misc_feature (31)..(31): n stands for inosine
cgcuggagcugaugaggccguuaggccgaanucucagg

SEQ ID NO: 5336 - RNA, 38 nt, Artificial Sequence
  Description of Artificial Sequence:  Enzymatic Nucleic Acid
  misc_feature (31)..(31): n stands for inosine
gcgcuggacugaugaggccguuaggccgaangucucag

SEQ ID NO: 5337 - RNA, 38 nt, Artificial Sequence
  Description of Artificial Sequence:  Enzymatic Nucleic Acid
  misc_feature (31)..(31): n stands for inosine
agcgcuggcugaugaggccguuaggccgaanggucuca

SEQ ID NO: 5338 - RNA, 38 nt, Artificial Sequence
  Description of Artificial Sequence:  Enzymatic Nucleic Acid
  misc_feature (31)..(31): n stands for inosine
gcagcgcucugaugaggccguuaggccgaanagggucu

SEQ ID NO: 5339 - RNA, 38 nt, Artificial Sequence
  Description of Artificial Sequence:  Enzymatic Nucleic Acid
  misc_feature (31)..(31): n stands for inosine
ggcagcgccugaugaggccguuaggccgaangaggguc

SEQ ID NO: 5340 - RNA, 38 nt, Artificial Sequence
  Description of Artificial Sequence:  Enzymatic Nucleic Acid
  misc_feature (31)..(31): n stands for inosine
cuccaggccugaugaggccguuaggccgaancgcugga

SEQ ID NO: 5341 - RNA, 38 nt, Artificial Sequence
  Description of Artificial Sequence:  Enzymatic Nucleic Acid
  misc_feature (31)..(31): n stands for inosine
cuccuccacugaugaggccguuaggccgaancagcgcu

SEQ ID NO: 5342 - RNA, 38 nt, Artificial Sequence
  Description of Artificial Sequence:  Enzymatic Nucleic Acid
  misc_feature (31)..(31): n stands for inosine
ucuccucccugaugaggccguuaggccgaangcagcgc

SEQ ID NO: 5343 - RNA, 38 nt, Artificial Sequence
  Description of Artificial Sequence:  Enzymatic Nucleic Acid
  misc_feature (31)..(31): n stands for inosine
ggagcucucugaugaggccguuaggccgaanauucucc

SEQ ID NO: 5344 - RNA, 38 nt, Artificial Sequence
  Description of Artificial Sequence:  Enzymatic Nucleic Acid
  misc_feature (31)..(31): n stands for inosine
caucucggcugaugaggccguuaggccgaancucuuga

SEQ ID NO: 5345 - RNA, 38 nt, Artificial Sequence
  Description of Artificial Sequence:  Enzymatic Nucleic Acid
  misc_feature (31)..(31): n stands for inosine
ggcaucuccugaugaggccguuaggccgaanagcucuu

SEQ ID NO: 5346 - RNA, 38 nt, Artificial Sequence
  Description of Artificial Sequence:  Enzymatic Nucleic Acid
  misc_feature (31)..(31): n stands for inosine
ugccggaucugaugaggccguuaggccgaancaucucg

SEQ ID NO: 5347 - RNA, 38 nt, Artificial Sequence
  Description of Artificial Sequence:  Enzymatic Nucleic Acid
  misc_feature (31)..(31): n stands for inosine
cugccggacugaugaggccguuaggccgaangcaucuc

SEQ ID NO: 5348 - RNA, 38 nt, Artificial Sequence
  Description of Artificial Sequence:  Enzymatic Nucleic Acid
  misc_feature (31)..(31): n stands for inosine
gcucugcccugaugaggccguuaggccgaanauggcau

SEQ ID NO: 5349 - RNA, 38 nt, Artificial Sequence
  Description of Artificial Sequence:  Enzymatic Nucleic Acid
  misc_feature (31)..(31): n stands for inosine
gguugcuccugaugaggccguuaggccgaanccggaug

SEQ ID NO: 5350 - RNA, 38 nt, Artificial Sequence
  Description of Artificial Sequence:  Enzymatic Nucleic Acid
  misc_feature (31)..(31): n stands for inosine
aaucuggucugaugaggccguuaggccgaancucugcc

SEQ ID NO: 5351 - RNA, 38 nt, Artificial Sequence
  Description of Artificial Sequence:  Enzymatic Nucleic Acid
  misc_feature (31)..(31): n stands for inosine
cagaaucucugaugaggccguuaggccgaanuugcucu

SEQ ID NO: 5352 - RNA, 38 nt, Artificial Sequence
  Description of Artificial Sequence:  Enzymatic Nucleic Acid
  misc_feature (31)..(31): n stands for inosine
gcagaauccugaugaggccguuaggccgaanguugcuc

SEQ ID NO: 5353 - RNA, 38 nt, Artificial Sequence
  Description of Artificial Sequence:  Enzymatic Nucleic Acid
  misc_feature (31)..(31): n stands for inosine
gcucccgccugaugaggccguuaggccgaanaaucugg

SEQ ID NO: 5354 - RNA, 38 nt, Artificial Sequence
  Description of Artificial Sequence:  Enzymatic Nucleic Acid
  misc_feature (31)..(31): n stands for inosine
cuccucgccugaugaggccguuaggccgaancgcuccc

SEQ ID NO: 5355 - RNA, 38 nt, Artificial Sequence
  Description of Artificial Sequence:  Enzymatic Nucleic Acid
  misc_feature (31)..(31): n stands for inosine
aaugcagacugaugaggccguuaggccgaancuccucg

SEQ ID NO: 5356 - RNA, 38 nt, Artificial Sequence
  Description of Artificial Sequence:  Enzymatic Nucleic Acid
  misc_feature (31)..(31): n stands for inosine
ggaaaugccugaugaggccguuaggccgaanaagcucc

SEQ ID NO: 5357 - RNA, 38 nt, Artificial Sequence
  Description of Artificial Sequence:  Enzymatic Nucleic Acid
  misc_feature (31)..(31): n stands for inosine
cuuggaaacugaugaggccguuaggccgaancagaagc

SEQ ID NO: 5358 - RNA, 38 nt, Artificial Sequence
  Description of Artificial Sequence:  Enzymatic Nucleic Acid
  misc_feature (31)..(31): n stands for inosine
gcuggcuucugaugaggccguuaggccgaanaaaugca

SEQ ID NO: 5359 - RNA, 38 nt, Artificial Sequence
  Description of Artificial Sequence:  Enzymatic Nucleic Acid
  misc_feature (31)..(31): n stands for inosine
ggcuggcucugaugaggccguuaggccgaangaaaugc

SEQ ID NO: 5360 - RNA, 38 nt, Artificial Sequence
  Description of Artificial Sequence:  Enzymatic Nucleic Acid
  misc_feature (31)..(31): n stands for inosine
cucuggcucugaugaggccguuaggccgaancuuggaa

SEQ ID NO: 5361 - RNA, 38 nt, Artificial Sequence
  Description of Artificial Sequence:  Enzymatic Nucleic Acid
  misc_feature (31)..(31): n stands for inosine
ccucuggccugaugaggccguuaggccgaangcuugga

SEQ ID NO: 5362 - RNA, 38 nt, Artificial Sequence
  Description of Artificial Sequence:  Enzymatic Nucleic Acid
  misc_feature (31)..(31): n stands for inosine
cucccucucugaugaggccguuaggccgaancuggcuu

SEQ ID NO: 5363 - RNA, 38 nt, Artificial Sequence
  Description of Artificial Sequence:  Enzymatic Nucleic Acid
  misc_feature (31)..(31): n stands for inosine
ccucccuccugaugaggccguuaggccgaangcuggcu

SEQ ID NO: 5364 - RNA, 38 nt, Artificial Sequence
  Description of Artificial Sequence:  Enzymatic Nucleic Acid
  misc_feature (31)..(31): n stands for inosine
gcacaugacugaugaggccguuaggccgaanaacuccu

SEQ ID NO: 5365 - RNA, 38 nt, Artificial Sequence
  Description of Artificial Sequence:  Enzymatic Nucleic Acid
  misc_feature (31)..(31): n stands for inosine
ugcacaugcugaugaggccguuaggccgaangaacucc

SEQ ID NO: 5366 - RNA, 38 nt, Artificial Sequence
  Description of Artificial Sequence:  Enzymatic Nucleic Acid
  misc_feature (31)..(31): n stands for inosine
cuugcacacugaugaggccguuaggccgaanaggaacu

SEQ ID NO: 5367 - RNA, 38 nt, Artificial Sequence
  Description of Artificial Sequence:  Enzymatic Nucleic Acid
  misc_feature (31)..(31): n stands for inosine
cuggaacucugaugaggccguuaggccgaancacauga

SEQ ID NO: 5368 - RNA, 38 nt, Artificial Sequence
  Description of Artificial Sequence:  Enzymatic Nucleic Acid
  misc_feature (31)..(31): n stands for inosine
ggccuccucugaugaggccguuaggccgaanaacuugc

SEQ ID NO: 5369 - RNA, 38 nt, Artificial Sequence
  Description of Artificial Sequence:  Enzymatic Nucleic Acid
  misc_feature (31)..(31): n stands for inosine
uggccucccugaugaggccguuaggccgaangaacuug

SEQ ID NO: 5370 - RNA, 38 nt, Artificial Sequence
  Description of Artificial Sequence:  Enzymatic Nucleic Acid
  misc_feature (31)..(31): n stands for inosine
aguuuccucugaugaggccguuaggccgaanccuccug

SEQ ID NO: 5371 - RNA, 38 nt, Artificial Sequence
  Description of Artificial Sequence:  Enzymatic Nucleic Acid
  misc_feature (31)..(31): n stands for inosine
caguuucccugaugaggccguuaggccgaangccuccu

SEQ ID NO: 5372 - RNA, 38 nt, Artificial Sequence
  Description of Artificial Sequence:  Enzymatic Nucleic Acid
  misc_feature (31)..(31): n stands for inosine
ucuccacccugaugaggccguuaggccgaanuuuccug

SEQ ID NO: 5373 - RNA, 38 nt, Artificial Sequence
  Description of Artificial Sequence:  Enzymatic Nucleic Acid
  misc_feature (31)..(31): n stands for inosine
ccaggccgcugaugaggccguuaggccgaanucucucc

SEQ ID NO: 5374 - RNA, 38 nt, Artificial Sequence
  Description of Artificial Sequence:  Enzymatic Nucleic Acid
  misc_feature (31)..(31): n stands for inosine
cuucuccacugaugaggccguuaggccgaanccgaguc

SEQ ID NO: 5375 - RNA, 38 nt, Artificial Sequence
  Description of Artificial Sequence:  Enzymatic Nucleic Acid
  misc_feature (31)..(31): n stands for inosine
gcuucucccugaugaggccguuaggccgaangccgagu

SEQ ID NO: 5376 - RNA, 38 nt, Artificial Sequence
  Description of Artificial Sequence:  Enzymatic Nucleic Acid
  misc_feature (31)..(31): n stands for inosine
ucagaucgcugaugaggccguuaggccgaancuucucc

SEQ ID NO: 5377 - RNA, 38 nt, Artificial Sequence
  Description of Artificial Sequence:  Enzymatic Nucleic Acid
  misc_feature (31)..(31): n stands for inosine
gccucuuccugaugaggccguuaggccgaanaucgagc

SEQ ID NO: 5378 - RNA, 38 nt, Artificial Sequence
  Description of Artificial Sequence:  Enzymatic Nucleic Acid
  misc_feature (31)..(31): n stands for inosine
gcuccuuccugaugaggccguuaggccgaanccucuuc

SEQ ID NO: 5379 - RNA, 38 nt, Artificial Sequence
  Description of Artificial Sequence:  Enzymatic Nucleic Acid
  misc_feature (31)..(31): n stands for inosine
gcagagcccugaugaggccguuaggccgaancuccuuc

SEQ ID NO: 5380 - RNA, 38 nt, Artificial Sequence
  Description of Artificial Sequence:  Enzymatic Nucleic Acid
  misc_feature (31)..(31): n stands for inosine
ucccgcagcugaugaggccguuaggccgaanccugcuc

SEQ ID NO: 5381 - RNA, 38 nt, Artificial Sequence
  Description of Artificial Sequence:  Enzymatic Nucleic Acid
  misc_feature (31)..(31): n stands for inosine
ccucccgccugaugaggccguuaggccgaanagccugc

SEQ ID NO: 5382 - RNA, 38 nt, Artificial Sequence
  Description of Artificial Sequence:  Enzymatic Nucleic Acid
  misc_feature (31)..(31): n stands for inosine
ucuucaggcugaugaggccguuaggccgaancuccacc

SEQ ID NO: 5383 - RNA, 38 nt, Artificial Sequence
  Description of Artificial Sequence:  Enzymatic Nucleic Acid
  misc_feature (31)..(31): n stands for inosine
ucucuucacugaugaggccguuaggccgaanugcucca

SEQ ID NO: 5384 - RNA, 38 nt, Artificial Sequence
  Description of Artificial Sequence:  Enzymatic Nucleic Acid
  misc_feature (31)..(31): n stands for inosine
aucucuuccugaugaggccguuaggccgaangugcucc

SEQ ID NO: 5385 - RNA, 38 nt, Artificial Sequence
  Description of Artificial Sequence:  Enzymatic Nucleic Acid
  misc_feature (31)..(31): n stands for inosine
cugcugcucugaugaggccguuaggccgaancaucucu

SEQ ID NO: 5386 - RNA, 38 nt, Artificial Sequence
  Description of Artificial Sequence:  Enzymatic Nucleic Acid
  misc_feature (31)..(31): n stands for inosine
ucugcugccugaugaggccguuaggccgaangcaucuc

SEQ ID NO: 5387 - RNA, 38 nt, Artificial Sequence
  Description of Artificial Sequence:  Enzymatic Nucleic Acid
  misc_feature (31)..(31): n stands for inosine
ccaucugccugaugaggccguuaggccgaancuggcau

SEQ ID NO: 5388 - RNA, 38 nt, Artificial Sequence
  Description of Artificial Sequence:  Enzymatic Nucleic Acid
  misc_feature (31)..(31): n stands for inosine
cagccauccugaugaggccguuaggccgaancugcugg

SEQ ID NO: 5389 - RNA, 38 nt, Artificial Sequence
  Description of Artificial Sequence:  Enzymatic Nucleic Acid
  misc_feature (31)..(31): n stands for inosine
uuguccuccugaugaggccguuaggccgaanccaucug

SEQ ID NO: 5390 - RNA, 38 nt, Artificial Sequence
  Description of Artificial Sequence:  Enzymatic Nucleic Acid
  misc_feature (31)..(31): n stands for inosine
agaggccucugaugaggccguuaggccgaanuccucag

SEQ ID NO: 5391 - RNA, 38 nt, Artificial Sequence
  Description of Artificial Sequence:  Enzymatic Nucleic Acid
  misc_feature (31)..(31): n stands for inosine
uucacagacugaugaggccguuaggccgaanccuuguc

SEQ ID NO: 5392 - RNA, 38 nt, Artificial Sequence
  Description of Artificial Sequence:  Enzymatic Nucleic Acid
  misc_feature (31)..(31): n stands for inosine
uuucacagcugaugaggccguuaggccgaangccuugu

SEQ ID NO: 5393 - RNA, 38 nt, Artificial Sequence
  Description of Artificial Sequence:  Enzymatic Nucleic Acid
  misc_feature (31)..(31): n stands for inosine
gcuuucaccugaugaggccguuaggccgaanaggccuu

SEQ ID NO: 5394 - RNA, 38 nt, Artificial Sequence
  Description of Artificial Sequence:  Enzymatic Nucleic Acid
  misc_feature (31)..(31): n stands for inosine
gucaccugcugaugaggccguuaggccgaancuuucac

SEQ ID NO: 5395 - RNA, 38 nt, Artificial Sequence
  Description of Artificial Sequence:  Enzymatic Nucleic Acid
  misc_feature (31)..(31): n stands for inosine
cgucaccucugaugaggccguuaggccgaangcuuuca

SEQ ID NO: 5396 - RNA, 38 nt, Artificial Sequence
  Description of Artificial Sequence:  Enzymatic Nucleic Acid
  misc_feature (31)..(31): n stands for inosine
acgucacccugaugaggccguuaggccgaanggcuuuc

SEQ ID NO: 5397 - RNA, 38 nt, Artificial Sequence
  Description of Artificial Sequence:  Enzymatic Nucleic Acid
  misc_feature (31)..(31): n stands for inosine
ccgagcaacugaugaggccguuaggccgaanacgucac

SEQ ID NO: 5398 - RNA, 38 nt, Artificial Sequence
  Description of Artificial Sequence:  Enzymatic Nucleic Acid
  misc_feature (31)..(31): n stands for inosine
cccgagcacugaugaggccguuaggccgaangacguca

SEQ ID NO: 5399 - RNA, 38 nt, Artificial Sequence
  Description of Artificial Sequence:  Enzymatic Nucleic Acid
  misc_feature (31)..(31): n stands for inosine
gcuccccgcugaugaggccguuaggccgaancaaggac

SEQ ID NO: 5400 - RNA, 38 nt, Artificial Sequence
  Description of Artificial Sequence:  Enzymatic Nucleic Acid
  misc_feature (31)..(31): n stands for inosine
ucuccugccugaugaggccguuaggccgaancuccccg

SEQ ID NO: 5401 - RNA, 38 nt, Artificial Sequence
  Description of Artificial Sequence:  Enzymatic Nucleic Acid
  misc_feature (31)..(31): n stands for inosine
ggcucucccugaugaggccguuaggccgaancagcucc

SEQ ID NO: 5402 - RNA, 38 nt, Artificial Sequence
  Description of Artificial Sequence:  Enzymatic Nucleic Acid
  misc_feature (31)..(31): n stands for inosine
gcgacucucugaugaggccguuaggccgaancucuccu

SEQ ID NO: 5403 - RNA, 38 nt, Artificial Sequence
  Description of Artificial Sequence:  Enzymatic Nucleic Acid
  misc_feature (31)..(31): n stands for inosine
agcgacuccugaugaggccguuaggccgaangcucucc

SEQ ID NO: 5404 - RNA, 38 nt, Artificial Sequence
  Description of Artificial Sequence:  Enzymatic Nucleic Acid
  misc_feature (31)..(31): n stands for inosine
agccuccacugaugaggccguuaggccgaancgacucu

SEQ ID NO: 5405 - RNA, 38 nt, Artificial Sequence
  Description of Artificial Sequence:  Enzymatic Nucleic Acid
  misc_feature (31)..(31): n stands for inosine
uuaguggccugaugaggccguuaggccgaanccuccaa

SEQ ID NO: 5406 - RNA, 38 nt, Artificial Sequence
  Description of Artificial Sequence:  Enzymatic Nucleic Acid
  misc_feature (31)..(31): n stands for inosine
uccuuagucugaugaggccguuaggccgaancagccuc

SEQ ID NO: 5407 - RNA, 38 nt, Artificial Sequence
  Description of Artificial Sequence:  Enzymatic Nucleic Acid
  misc_feature (31)..(31): n stands for inosine
uuccuuagcugaugaggccguuaggccgaangcagccu

SEQ ID NO: 5408 - RNA, 38 nt, Artificial Sequence
  Description of Artificial Sequence:  Enzymatic Nucleic Acid
  misc_feature (31)..(31): n stands for inosine
cauuccuucugaugaggccguuaggccgaanuggcagc

SEQ ID NO: 5409 - RNA, 38 nt, Artificial Sequence
  Description of Artificial Sequence:  Enzymatic Nucleic Acid
  misc_feature (31)..(31): n stands for inosine
cagagccucugaugaggccguuaggccgaancauuccu

SEQ ID NO: 5410 - RNA, 38 nt, Artificial Sequence
  Description of Artificial Sequence:  Enzymatic Nucleic Acid
  misc_feature (31)..(31): n stands for inosine
ccagagcccugaugaggccguuaggccgaangcauucc

SEQ ID NO: 5411 - RNA, 38 nt, Artificial Sequence
  Description of Artificial Sequence:  Enzymatic Nucleic Acid
  misc_feature (31)..(31): n stands for inosine
cccuccagcugaugaggccguuaggccgaanccuggca

SEQ ID NO: 5412 - RNA, 38 nt, Artificial Sequence
  Description of Artificial Sequence:  Enzymatic Nucleic Acid
  misc_feature (31)..(31): n stands for inosine
gacccucccugaugaggccguuaggccgaanagccugg

SEQ ID NO: 5413 - RNA, 38 nt, Artificial Sequence
  Description of Artificial Sequence:  Enzymatic Nucleic Acid
  misc_feature (31)..(31): n stands for inosine
gccgcccgcugaugaggccguuaggccgaancccgacc

SEQ ID NO: 5414 - RNA, 38 nt, Artificial Sequence
  Description of Artificial Sequence:  Enzymatic Nucleic Acid
  misc_feature (31)..(31): n stands for inosine
ggccgccccugaugaggccguuaggccgaangcccgac

SEQ ID NO: 5415 - RNA, 38 nt, Artificial Sequence
  Description of Artificial Sequence:  Enzymatic Nucleic Acid
  misc_feature (31)..(31): n stands for inosine
ugcucgcucugaugaggccguuaggccgaanccgcccg

SEQ ID NO: 5416 - RNA, 38 nt, Artificial Sequence
  Description of Artificial Sequence:  Enzymatic Nucleic Acid
  misc_feature (31)..(31): n stands for inosine
cugcucgccugaugaggccguuaggccgaangccgccc

SEQ ID NO: 5417 - RNA, 38 nt, Artificial Sequence
  Description of Artificial Sequence:  Enzymatic Nucleic Acid
  misc_feature (31)..(31): n stands for inosine
gccgcgcccugaugaggccguuaggccgaancucgcug

SEQ ID NO: 5418 - RNA, 38 nt, Artificial Sequence
  Description of Artificial Sequence:  Enzymatic Nucleic Acid
  misc_feature (31)..(31): n stands for inosine
ucuccagccugaugaggccguuaggccgaanccgcgcc

SEQ ID NO: 5419 - RNA, 38 nt, Artificial Sequence
  Description of Artificial Sequence:  Enzymatic Nucleic Acid
  misc_feature (31)..(31): n stands for inosine
cacucucccugaugaggccguuaggccgaancugccgc

SEQ ID NO: 5420 - RNA, 38 nt, Artificial Sequence
  Description of Artificial Sequence:  Enzymatic Nucleic Acid
  misc_feature (31)..(31): n stands for inosine
gcugcugccugaugaggccguuaggccgaancgccucg

SEQ ID NO: 5421 - RNA, 38 nt, Artificial Sequence
  Description of Artificial Sequence:  Enzymatic Nucleic Acid
  misc_feature (31)..(31): n stands for inosine
gcugcugccugaugaggccguuaggccgaancagcgcc

SEQ ID NO: 5422 - RNA, 38 nt, Artificial Sequence
  Description of Artificial Sequence:  Enzymatic Nucleic Acid
  misc_feature (31)..(31): n stands for inosine
ugugcugccugaugaggccguuaggccgaancugcagc

SEQ ID NO: 5423 - RNA, 38 nt, Artificial Sequence
  Description of Artificial Sequence:  Enzymatic Nucleic Acid
  misc_feature (31)..(31): n stands for inosine
cgcugugccugaugaggccguuaggccgaancugcugc

SEQ ID NO: 5424 - RNA, 38 nt, Artificial Sequence
  Description of Artificial Sequence:  Enzymatic Nucleic Acid
  misc_feature (31)..(31): n stands for inosine
gcacgcugcugaugaggccguuaggccgaancugcugc

SEQ ID NO: 5425 - RNA, 38 nt, Artificial Sequence
  Description of Artificial Sequence:  Enzymatic Nucleic Acid
  misc_feature (31)..(31): n stands for inosine
cugcacgccugaugaggccguuaggccgaanugcugcu

SEQ ID NO: 5426 - RNA, 38 nt, Artificial Sequence
  Description of Artificial Sequence:  Enzymatic Nucleic Acid
  misc_feature (31)..(31): n stands for inosine
gguccacccugaugaggccguuaggccgaancacgcug

SEQ ID NO: 5427 - RNA, 38 nt, Artificial Sequence
  Description of Artificial Sequence:  Enzymatic Nucleic Acid
  misc_feature (31)..(31): n stands for inosine
gcgcagcucugaugaggccguuaggccgaanuccaccu

SEQ ID NO: 5428 - RNA, 38 nt, Artificial Sequence
  Description of Artificial Sequence:  Enzymatic Nucleic Acid
  misc_feature (31)..(31): n stands for inosine
ugcgcagccugaugaggccguuaggccgaanguccacc

SEQ ID NO: 5429 - RNA, 38 nt, Artificial Sequence
  Description of Artificial Sequence:  Enzymatic Nucleic Acid
  misc_feature (31)..(31): n stands for inosine
gcaugcgccugaugaggccguuaggccgaancuggucc

SEQ ID NO: 5430 - RNA, 38 nt, Artificial Sequence
  Description of Artificial Sequence:  Enzymatic Nucleic Acid
  misc_feature (31)..(31): n stands for inosine
gcccugcacugaugaggccguuaggccgaancgcagcu

SEQ ID NO: 5431 - RNA, 38 nt, Artificial Sequence
  Description of Artificial Sequence:  Enzymatic Nucleic Acid
  misc_feature (31)..(31): n stands for inosine
ucuggccccugaugaggccguuaggccgaancaugcgc

SEQ ID NO: 5432 - RNA, 38 nt, Artificial Sequence
  Description of Artificial Sequence:  Enzymatic Nucleic Acid
  misc_feature (31)..(31): n stands for inosine
cacgcucucugaugaggccguuaggccgaancccugca

SEQ ID NO: 5433 - RNA, 38 nt, Artificial Sequence
  Description of Artificial Sequence:  Enzymatic Nucleic Acid
  misc_feature (31)..(31): n stands for inosine
ccacgcuccugaugaggccguuaggccgaangcccugc

SEQ ID NO: 5434 - RNA, 38 nt, Artificial Sequence
  Description of Artificial Sequence:  Enzymatic Nucleic Acid
  misc_feature (31)..(31): n stands for inosine
cggagcgccugaugaggccguuaggccgaanccuccac

SEQ ID NO: 5435 - RNA, 38 nt, Artificial Sequence
  Description of Artificial Sequence:  Enzymatic Nucleic Acid
  misc_feature (31)..(31): n stands for inosine
ccaugcggcugaugaggccguuaggccgaancgcggcc

SEQ ID NO: 5436 - RNA, 38 nt, Artificial Sequence
  Description of Artificial Sequence:  Enzymatic Nucleic Acid
  misc_feature (31)..(31): n stands for inosine
cuccaugccugaugaggccguuaggccgaanagcgcgg

SEQ ID NO: 5437 - RNA, 38 nt, Artificial Sequence
  Description of Artificial Sequence:  Enzymatic Nucleic Acid
  misc_feature (31)..(31): n stands for inosine
gcgcuccacugaugaggccguuaggccgaancggagcg

SEQ ID NO: 5438 - RNA, 38 nt, Artificial Sequence
  Description of Artificial Sequence:  Enzymatic Nucleic Acid
  misc_feature (31)..(31): n stands for inosine
ggcggccucugaugaggccguuaggccgaancgcucca

SEQ ID NO: 5439 - RNA, 38 nt, Artificial Sequence
  Description of Artificial Sequence:  Enzymatic Nucleic Acid
  misc_feature (31)..(31): n stands for inosine
aggcggcccugaugaggccguuaggccgaangcgcucc

SEQ ID NO: 5440 - RNA, 38 nt, Artificial Sequence
  Description of Artificial Sequence:  Enzymatic Nucleic Acid
  misc_feature (31)..(31): n stands for inosine
uccgaggccugaugaggccguuaggccgaanccuggcg

SEQ ID NO: 5441 - RNA, 38 nt, Artificial Sequence
  Description of Artificial Sequence:  Enzymatic Nucleic Acid
  misc_feature (31)..(31): n stands for inosine
uccuccgacugaugaggccguuaggccgaancggccug

SEQ ID NO: 5442 - RNA, 38 nt, Artificial Sequence
  Description of Artificial Sequence:  Enzymatic Nucleic Acid
  misc_feature (31)..(31): n stands for inosine
cuccuccgcugaugaggccguuaggccgaangcggccu

SEQ ID NO: 5443 - RNA, 38 nt, Artificial Sequence
  Description of Artificial Sequence:  Enzymatic Nucleic Acid
  misc_feature (31)..(31): n stands for inosine
acugggcccugaugaggccguuaggccgaancuuccuc

SEQ ID NO: 5444 - RNA, 38 nt, Artificial Sequence
  Description of Artificial Sequence:  Enzymatic Nucleic Acid
  misc_feature (31)..(31): n stands for inosine
ugcaacugcugaugaggccguuaggccgaanccagcuu

SEQ ID NO: 5445 - RNA, 38 nt, Artificial Sequence
  Description of Artificial Sequence:  Enzymatic Nucleic Acid
  misc_feature (31)..(31): n stands for inosine
cugcaacucugaugaggccguuaggccgaangccagcu

SEQ ID NO: 5446 - RNA, 38 nt, Artificial Sequence
  Description of Artificial Sequence:  Enzymatic Nucleic Acid
  misc_feature (31)..(31): n stands for inosine
ccugcaaccugaugaggccguuaggccgaanggccagc

SEQ ID NO: 5447 - RNA, 38 nt, Artificial Sequence
  Description of Artificial Sequence:  Enzymatic Nucleic Acid
  misc_feature (31)..(31): n stands for inosine
aggccacccugaugaggccguuaggccgaancaacugg

SEQ ID NO: 5448 - RNA, 38 nt, Artificial Sequence
  Description of Artificial Sequence:  Enzymatic Nucleic Acid
  misc_feature (31)..(31): n stands for inosine
uggugauacugaugaggccguuaggccgaanccaccug

SEQ ID NO: 5449 - RNA, 38 nt, Artificial Sequence
  Description of Artificial Sequence:  Enzymatic Nucleic Acid
  misc_feature (31)..(31): n stands for inosine
cuggugaucugaugaggccguuaggccgaangccaccu

SEQ ID NO: 5450 - RNA, 38 nt, Artificial Sequence
  Description of Artificial Sequence:  Enzymatic Nucleic Acid
  misc_feature (31)..(31): n stands for inosine
agagcuggcugaugaggccguuaggccgaanauaggcc

SEQ ID NO: 5451 - RNA, 38 nt, Artificial Sequence
  Description of Artificial Sequence:  Enzymatic Nucleic Acid
  misc_feature (31)..(31): n stands for inosine
gaagagcucugaugaggccguuaggccgaanugauagg

SEQ ID NO: 5452 - RNA, 38 nt, Artificial Sequence
  Description of Artificial Sequence:  Enzymatic Nucleic Acid
  misc_feature (31)..(31): n stands for inosine
ggaagagccugaugaggccguuaggccgaangugauag

SEQ ID NO: 5453 - RNA, 38 nt, Artificial Sequence
  Description of Artificial Sequence:  Enzymatic Nucleic Acid
  misc_feature (31)..(31): n stands for inosine
cuuggaagcugaugaggccguuaggccgaancugguga

SEQ ID NO: 5454 - RNA, 38 nt, Artificial Sequence
  Description of Artificial Sequence:  Enzymatic Nucleic Acid
  misc_feature (31)..(31): n stands for inosine
uucuuggacugaugaggccguuaggccgaanagcuggu

SEQ ID NO: 5455 - RNA, 38 nt, Artificial Sequence
  Description of Artificial Sequence:  Enzymatic Nucleic Acid
  misc_feature (31)..(31): n stands for inosine
guauucuucugaugaggccguuaggccgaanaagagcu

SEQ ID NO: 5456 - RNA, 38 nt, Artificial Sequence
  Description of Artificial Sequence:  Enzymatic Nucleic Acid
  misc_feature (31)..(31): n stands for inosine
cguauucucugaugaggccguuaggccgaangaagagc

SEQ ID NO: 5457 - RNA, 38 nt, Artificial Sequence
  Description of Artificial Sequence:  Enzymatic Nucleic Acid
  misc_feature (31)..(31): n stands for inosine
gauguggucugaugaggccguuaggccgaanucguauu

SEQ ID NO: 5458 - RNA, 38 nt, Artificial Sequence
  Description of Artificial Sequence:  Enzymatic Nucleic Acid
  misc_feature (31)..(31): n stands for inosine
cuugaugucugaugaggccguuaggccgaanuugucgu

SEQ ID NO: 5459 - RNA, 38 nt, Artificial Sequence
  Description of Artificial Sequence:  Enzymatic Nucleic Acid
  misc_feature (31)..(31): n stands for inosine
ucuugaugcugaugaggccguuaggccgaanguugucg

SEQ ID NO: 5460 - RNA, 38 nt, Artificial Sequence
  Description of Artificial Sequence:  Enzymatic Nucleic Acid
  misc_feature (31)..(31): n stands for inosine
gcucuugacugaugaggccguuaggccgaanugguugu

SEQ ID NO: 5461 - RNA, 38 nt, Artificial Sequence
  Description of Artificial Sequence:  Enzymatic Nucleic Acid
  misc_feature (31)..(31): n stands for inosine
gcugcucucugaugaggccguuaggccgaanauguggu

SEQ ID NO: 5462 - RNA, 38 nt, Artificial Sequence
  Description of Artificial Sequence:  Enzymatic Nucleic Acid
  misc_feature (31)..(31): n stands for inosine
caccacgccugaugaggccguuaggccgaancucuuga

SEQ ID NO: 5463 - RNA, 38 nt, Artificial Sequence
  Description of Artificial Sequence:  Enzymatic Nucleic Acid
  misc_feature (31)..(31): n stands for inosine
ccgcucaccugaugaggccguuaggccgaancccacca

SEQ ID NO: 5464 - RNA, 38 nt, Artificial Sequence
  Description of Artificial Sequence:  Enzymatic Nucleic Acid
  misc_feature (31)..(31): n stands for inosine
cuuccagccugaugaggccguuaggccgaancauuccu

SEQ ID NO: 5465 - RNA, 38 nt, Artificial Sequence
  Description of Artificial Sequence:  Enzymatic Nucleic Acid
  misc_feature (31)..(31): n stands for inosine
gaucuucccugaugaggccguuaggccgaancugcauu

SEQ ID NO: 5466 - RNA, 38 nt, Artificial Sequence
  Description of Artificial Sequence:  Enzymatic Nucleic Acid
  misc_feature (31)..(31): n stands for inosine
gcuguuugcugaugaggccguuaggccgaanaucuucc

SEQ ID NO: 5467 - RNA, 38 nt, Artificial Sequence
  Description of Artificial Sequence:  Enzymatic Nucleic Acid
  misc_feature (31)..(31): n stands for inosine
cugcuguucugaugaggccguuaggccgaanagaucuu

SEQ ID NO: 5468 - RNA, 38 nt, Artificial Sequence
  Description of Artificial Sequence:  Enzymatic Nucleic Acid
  misc_feature (31)..(31): n stands for inosine
ggagcugccugaugaggccguuaggccgaanuuugaga

SEQ ID NO: 5469 - RNA, 38 nt, Artificial Sequence
  Description of Artificial Sequence:  Enzymatic Nucleic Acid
  misc_feature (31)..(31): n stands for inosine
gcuggagccugaugaggccguuaggccgaancuguuug

SEQ ID NO: 5470 - RNA, 38 nt, Artificial Sequence
  Description of Artificial Sequence:  Enzymatic Nucleic Acid
  misc_feature (31)..(31): n stands for inosine
ccugcuggcugaugaggccguuaggccgaancugcugu

SEQ ID NO: 5471 - RNA, 38 nt, Artificial Sequence
  Description of Artificial Sequence:  Enzymatic Nucleic Acid
  misc_feature (31)..(31): n stands for inosine
ggccugcucugaugaggccguuaggccgaanagcugcu

SEQ ID NO: 5472 - RNA, 38 nt, Artificial Sequence
  Description of Artificial Sequence:  Enzymatic Nucleic Acid
  misc_feature (31)..(31): n stands for inosine
cggccugccugaugaggccguuaggccgaangagcugc

SEQ ID NO: 5473 - RNA, 38 nt, Artificial Sequence
  Description of Artificial Sequence:  Enzymatic Nucleic Acid
  misc_feature (31)..(31): n stands for inosine
ccucggcccugaugaggccguuaggccgaancuggagc

SEQ ID NO: 5474 - RNA, 38 nt, Artificial Sequence
  Description of Artificial Sequence:  Enzymatic Nucleic Acid
  misc_feature (31)..(31): n stands for inosine
gccuccuccugaugaggccguuaggccgaanccugcug

SEQ ID NO: 5475 - RNA, 38 nt, Artificial Sequence
  Description of Artificial Sequence:  Enzymatic Nucleic Acid
  misc_feature (31)..(31): n stands for inosine
gccaccagcugaugaggccguuaggccgaanccuccuc

SEQ ID NO: 5476 - RNA, 38 nt, Artificial Sequence
  Description of Artificial Sequence:  Enzymatic Nucleic Acid
  misc_feature (31)..(31): n stands for inosine
ggccaccacugaugaggccguuaggccgaangccuccu

SEQ ID NO: 5477 - RNA, 38 nt, Artificial Sequence
  Description of Artificial Sequence:  Enzymatic Nucleic Acid
  misc_feature (31)..(31): n stands for inosine
uggccacccugaugaggccguuaggccgaanggccucc

SEQ ID NO: 5478 - RNA, 38 nt, Artificial Sequence
  Description of Artificial Sequence:  Enzymatic Nucleic Acid
  misc_feature (31)..(31): n stands for inosine
uccuguuucugaugaggccguuaggccgaanccaccag

SEQ ID NO: 5479 - RNA, 38 nt, Artificial Sequence
  Description of Artificial Sequence:  Enzymatic Nucleic Acid
  misc_feature (31)..(31): n stands for inosine
cuccuguucugaugaggccguuaggccgaangccacca

SEQ ID NO: 5480 - RNA, 38 nt, Artificial Sequence
  Description of Artificial Sequence:  Enzymatic Nucleic Acid
  misc_feature (31)..(31): n stands for inosine
ucaccucccugaugaggccguuaggccgaanuuuggcc

SEQ ID NO: 5481 - RNA, 38 nt, Artificial Sequence
  Description of Artificial Sequence:  Enzymatic Nucleic Acid
  misc_feature (31)..(31): n stands for inosine
ccuccuuccugaugaggccguuaggccgaancuuaucg

SEQ ID NO: 5482 - RNA, 38 nt, Artificial Sequence
  Description of Artificial Sequence:  Enzymatic Nucleic Acid
  misc_feature (31)..(31): n stands for inosine
ugcugcuccugaugaggccguuaggccgaanccuccuc

SEQ ID NO: 5483 - RNA, 38 nt, Artificial Sequence
  Description of Artificial Sequence:  Enzymatic Nucleic Acid
  misc_feature (31)..(31): n stands for inosine
ucuugugccugaugaggccguuaggccgaancucggcc

SEQ ID NO: 5484 - RNA, 38 nt, Artificial Sequence
  Description of Artificial Sequence:  Enzymatic Nucleic Acid
  misc_feature (31)..(31): n stands for inosine
caaucuugcugaugaggccguuaggccgaancugcucg

SEQ ID NO: 5485 - RNA, 38 nt, Artificial Sequence
  Description of Artificial Sequence:  Enzymatic Nucleic Acid
  misc_feature (31)..(31): n stands for inosine
cacaaucucugaugaggccguuaggccgaanugcugcu

SEQ ID NO: 5486 - RNA, 38 nt, Artificial Sequence
  Description of Artificial Sequence:  Enzymatic Nucleic Acid
  misc_feature (31)..(31): n stands for inosine
accggaaccugaugaggccguuaggccgaanucuccau

SEQ ID NO: 5487 - RNA, 38 nt, Artificial Sequence
  Description of Artificial Sequence:  Enzymatic Nucleic Acid
  misc_feature (31)..(31): n stands for inosine
ucagcacccugaugaggccguuaggccgaanaacgguc

SEQ ID NO: 5488 - RNA, 38 nt, Artificial Sequence
  Description of Artificial Sequence:  Enzymatic Nucleic Acid
  misc_feature (31)..(31): n stands for inosine
gggccuuccugaugaggccguuaggccgaancaccgga

SEQ ID NO: 5489 - RNA, 38 nt, Artificial Sequence
  Description of Artificial Sequence:  Enzymatic Nucleic Acid
  misc_feature (31)..(31): n stands for inosine
uccgccugcugaugaggccguuaggccgaanccuucag

SEQ ID NO: 5490 - RNA, 38 nt, Artificial Sequence
  Description of Artificial Sequence:  Enzymatic Nucleic Acid
  misc_feature (31)..(31): n stands for inosine
auccgccucugaugaggccguuaggccgaangccuuca

SEQ ID NO: 5491 - RNA, 38 nt, Artificial Sequence
  Description of Artificial Sequence:  Enzymatic Nucleic Acid
  misc_feature (31)..(31): n stands for inosine
uauccgcccugaugaggccguuaggccgaanggccuuc

SEQ ID NO: 5492 - RNA, 38 nt, Artificial Sequence
  Description of Artificial Sequence:  Enzymatic Nucleic Acid
  misc_feature (31)..(31): n stands for inosine
cgccuugucugaugaggccguuaggccgaanauauccg

SEQ ID NO: 5493 - RNA, 38 nt, Artificial Sequence
  Description of Artificial Sequence:  Enzymatic Nucleic Acid
  misc_feature (31)..(31): n stands for inosine
guccgccucugaugaggccguuaggccgaanuagauau

SEQ ID NO: 5494 - RNA, 38 nt, Artificial Sequence
  Description of Artificial Sequence:  Enzymatic Nucleic Acid
  misc_feature (31)..(31): n stands for inosine
agccuggacugaugaggccguuaggccgaanuccgccu

SEQ ID NO: 5495 - RNA, 38 nt, Artificial Sequence
  Description of Artificial Sequence:  Enzymatic Nucleic Acid
  misc_feature (31)..(31): n stands for inosine
cucagccucugaugaggccguuaggccgaanaaguccg

SEQ ID NO: 5496 - RNA, 38 nt, Artificial Sequence
  Description of Artificial Sequence:  Enzymatic Nucleic Acid
  misc_feature (31)..(31): n stands for inosine
ucucagcccugaugaggccguuaggccgaangaagucc

SEQ ID NO: 5497 - RNA, 38 nt, Artificial Sequence
  Description of Artificial Sequence:  Enzymatic Nucleic Acid
  misc_feature (31)..(31): n stands for inosine
ugccucuccugaugaggccguuaggccgaanccuggaa

SEQ ID NO: 5498 - RNA, 38 nt, Artificial Sequence
  Description of Artificial Sequence:  Enzymatic Nucleic Acid
  misc_feature (31)..(31): n stands for inosine
cccgggcccugaugaggccguuaggccgaanccucuca

SEQ ID NO: 5499 - RNA, 38 nt, Artificial Sequence
  Description of Artificial Sequence:  Enzymatic Nucleic Acid
  misc_feature (31)..(31): n stands for inosine
uucucccgcugaugaggccguuaggccgaanccugccu

SEQ ID NO: 5500 - RNA, 38 nt, Artificial Sequence
  Description of Artificial Sequence:  Enzymatic Nucleic Acid
  misc_feature (31)..(31): n stands for inosine
cuucuccccugaugaggccguuaggccgaangccugcc

SEQ ID NO: 5501 - RNA, 38 nt, Artificial Sequence
  Description of Artificial Sequence:  Enzymatic Nucleic Acid
  misc_feature (31)..(31): n stands for inosine
ucucggcccugaugaggccguuaggccgaancuucucc

SEQ ID NO: 5502 - RNA, 38 nt, Artificial Sequence
  Description of Artificial Sequence:  Enzymatic Nucleic Acid
  misc_feature (31)..(31): n stands for inosine
uucuucuccugaugaggccguuaggccgaanccagcuu

SEQ ID NO: 5503 - RNA, 38 nt, Artificial Sequence
  Description of Artificial Sequence:  Enzymatic Nucleic Acid
  misc_feature (31)..(31): n stands for inosine
ccugcaggcugaugaggccguuaggccgaancuccuuc

SEQ ID NO: 5504 - RNA, 38 nt, Artificial Sequence
  Description of Artificial Sequence:  Enzymatic Nucleic Acid
  misc_feature (31)..(31): n stands for inosine
cuccugcacugaugaggccguuaggccgaanagcuccu

SEQ ID NO: 5505 - RNA, 38 nt, Artificial Sequence
  Description of Artificial Sequence:  Enzymatic Nucleic Acid
  misc_feature (31)..(31): n stands for inosine
gcuccugccugaugaggccguuaggccgaangagcucc

SEQ ID NO: 5506 - RNA, 38 nt, Artificial Sequence
  Description of Artificial Sequence:  Enzymatic Nucleic Acid
  misc_feature (31)..(31): n stands for inosine
gcugcucccugaugaggccguuaggccgaancaggagc

SEQ ID NO: 5507 - RNA, 38 nt, Artificial Sequence
  Description of Artificial Sequence:  Enzymatic Nucleic Acid
  misc_feature (31)..(31): n stands for inosine
gcuccagccugaugaggccguuaggccgaancuccugc

SEQ ID NO: 5508 - RNA, 38 nt, Artificial Sequence
  Description of Artificial Sequence:  Enzymatic Nucleic Acid
  misc_feature (31)..(31): n stands for inosine
gcugcucccugaugaggccguuaggccgaancugcucc

SEQ ID NO: 5509 - RNA, 38 nt, Artificial Sequence
  Description of Artificial Sequence:  Enzymatic Nucleic Acid
  misc_feature (31)..(31): n stands for inosine
ucugcagccugaugaggccguuaggccgaancuccagc

SEQ ID NO: 5510 - RNA, 38 nt, Artificial Sequence
  Description of Artificial Sequence:  Enzymatic Nucleic Acid
  misc_feature (31)..(31): n stands for inosine
cccucugccugaugaggccguuaggccgaancugcucc

SEQ ID NO: 5511 - RNA, 38 nt, Artificial Sequence
  Description of Artificial Sequence:  Enzymatic Nucleic Acid
  misc_feature (31)..(31): n stands for inosine
acucccuccugaugaggccguuaggccgaancagcugc

SEQ ID NO: 5512 - RNA, 38 nt, Artificial Sequence
  Description of Artificial Sequence:  Enzymatic Nucleic Acid
  misc_feature (31)..(31): n stands for inosine
caguuugccugaugaggccguuaggccgaanuacuccc

SEQ ID NO: 5513 - RNA, 38 nt, Artificial Sequence
  Description of Artificial Sequence:  Enzymatic Nucleic Acid
  misc_feature (31)..(31): n stands for inosine
cuucaguucugaugaggccguuaggccgaancuguacu

SEQ ID NO: 5514 - RNA, 38 nt, Artificial Sequence
  Description of Artificial Sequence:  Enzymatic Nucleic Acid
  misc_feature (31)..(31): n stands for inosine
uggccuuccugaugaggccguuaggccgaanuuugcug

SEQ ID NO: 5515 - RNA, 38 nt, Artificial Sequence
  Description of Artificial Sequence:  Enzymatic Nucleic Acid
  misc_feature (31)..(31): n stands for inosine
ugacagcucugaugaggccguuaggccgaanccuucag

SEQ ID NO: 5516 - RNA, 38 nt, Artificial Sequence
  Description of Artificial Sequence:  Enzymatic Nucleic Acid
  misc_feature (31)..(31): n stands for inosine
cugacagccugaugaggccguuaggccgaangccuuca

SEQ ID NO: 5517 - RNA, 38 nt, Artificial Sequence
  Description of Artificial Sequence:  Enzymatic Nucleic Acid
  misc_feature (31)..(31): n stands for inosine
cuccugaccugaugaggccguuaggccgaancuggccu

SEQ ID NO: 5518 - RNA, 38 nt, Artificial Sequence
  Description of Artificial Sequence:  Enzymatic Nucleic Acid
  misc_feature (31)..(31): n stands for inosine
ccgacucccugaugaggccguuaggccgaanacagcug

SEQ ID NO: 5519 - RNA, 38 nt, Artificial Sequence
  Description of Artificial Sequence:  Enzymatic Nucleic Acid
  misc_feature (31)..(31): n stands for inosine
ucgauccucugaugaggccguuaggccgaanccgacuc

SEQ ID NO: 5520 - RNA, 38 nt, Artificial Sequence
  Description of Artificial Sequence:  Enzymatic Nucleic Acid
  misc_feature (31)..(31): n stands for inosine
cucgaucccugaugaggccguuaggccgaangccgacu

SEQ ID NO: 5521 - RNA, 38 nt, Artificial Sequence
  Description of Artificial Sequence:  Enzymatic Nucleic Acid
  misc_feature (31)..(31): n stands for inosine
cuuccucacugaugaggccguuaggccgaanuccucga

SEQ ID NO: 5522 - RNA, 38 nt, Artificial Sequence
  Description of Artificial Sequence:  Enzymatic Nucleic Acid
  misc_feature (31)..(31): n stands for inosine
ccucgacacugaugaggccguuaggccgaanccgcuuc

SEQ ID NO: 5523 - RNA, 38 nt, Artificial Sequence
  Description of Artificial Sequence:  Enzymatic Nucleic Acid
  misc_feature (31)..(31): n stands for inosine
ggccugggcugaugaggccguuaggccgaanaccucga

SEQ ID NO: 5524 - RNA, 38 nt, Artificial Sequence
  Description of Artificial Sequence:  Enzymatic Nucleic Acid
  misc_feature (31)..(31): n stands for inosine
ggggccugcugaugaggccguuaggccgaanagaccuc

SEQ ID NO: 5525 - RNA, 38 nt, Artificial Sequence
  Description of Artificial Sequence:  Enzymatic Nucleic Acid
  misc_feature (31)..(31): n stands for inosine
gggggccucugaugaggccguuaggccgaangagaccu

SEQ ID NO: 5526 - RNA, 38 nt, Artificial Sequence
  Description of Artificial Sequence:  Enzymatic Nucleic Acid
  misc_feature (31)..(31): n stands for inosine
agggggcccugaugaggccguuaggccgaanggagacc

SEQ ID NO: 5527 - RNA, 38 nt, Artificial Sequence
  Description of Artificial Sequence:  Enzymatic Nucleic Acid
  misc_feature (31)..(31): n stands for inosine
ggcaagggcugaugaggccguuaggccgaanccuggga

SEQ ID NO: 5528 - RNA, 38 nt, Artificial Sequence
  Description of Artificial Sequence:  Enzymatic Nucleic Acid
  misc_feature (31)..(31): n stands for inosine
gggcaaggcugaugaggccguuaggccgaangccuggg

SEQ ID NO: 5529 - RNA, 38 nt, Artificial Sequence
  Description of Artificial Sequence:  Enzymatic Nucleic Acid
  misc_feature (31)..(31): n stands for inosine
ggggcaagcugaugaggccguuaggccgaanggccugg

SEQ ID NO: 5530 - RNA, 38 nt, Artificial Sequence
  Description of Artificial Sequence:  Enzymatic Nucleic Acid
  misc_feature (31)..(31): n stands for inosine
gggggcaacugaugaggccguuaggccgaangggccug

SEQ ID NO: 5531 - RNA, 38 nt, Artificial Sequence
  Description of Artificial Sequence:  Enzymatic Nucleic Acid
  misc_feature (31)..(31): n stands for inosine
ggggggcacugaugaggccguuaggccgaanggggccu

SEQ ID NO: 5532 - RNA, 38 nt, Artificial Sequence
  Description of Artificial Sequence:  Enzymatic Nucleic Acid
  misc_feature (31)..(31): n stands for inosine
gggcggggcugaugaggccguuaggccgaancaagggg

SEQ ID NO: 5533 - RNA, 38 nt, Artificial Sequence
  Description of Artificial Sequence:  Enzymatic Nucleic Acid
  misc_feature (31)..(31): n stands for inosine
ggggcgggcugaugaggccguuaggccgaangcaaggg

SEQ ID NO: 5534 - RNA, 38 nt, Artificial Sequence
  Description of Artificial Sequence:  Enzymatic Nucleic Acid
  misc_feature (31)..(31): n stands for inosine
aggggcggcugaugaggccguuaggccgaanggcaagg

SEQ ID NO: 5535 - RNA, 38 nt, Artificial Sequence
  Description of Artificial Sequence:  Enzymatic Nucleic Acid
  misc_feature (31)..(31): n stands for inosine
caggggcgcugaugaggccguuaggccgaangggcaag

SEQ ID NO: 5536 - RNA, 38 nt, Artificial Sequence
  Description of Artificial Sequence:  Enzymatic Nucleic Acid
  misc_feature (31)..(31): n stands for inosine
gcaggggccugaugaggccguuaggccgaanggggcaa

SEQ ID NO: 5537 - RNA, 38 nt, Artificial Sequence
  Description of Artificial Sequence:  Enzymatic Nucleic Acid
  misc_feature (31)..(31): n stands for inosine
uaggcaggcugaugaggccguuaggccgaancgggggg

SEQ ID NO: 5538 - RNA, 38 nt, Artificial Sequence
  Description of Artificial Sequence:  Enzymatic Nucleic Acid
  misc_feature (31)..(31): n stands for inosine
guaggcagcugaugaggccguuaggccgaangcggggg

SEQ ID NO: 5539 - RNA, 38 nt, Artificial Sequence
  Description of Artificial Sequence:  Enzymatic Nucleic Acid
  misc_feature (31)..(31): n stands for inosine
gguaggcacugaugaggccguuaggccgaanggcgggg

SEQ ID NO: 5540 - RNA, 38 nt, Artificial Sequence
  Description of Artificial Sequence:  Enzymatic Nucleic Acid
  misc_feature (31)..(31): n stands for inosine
agguaggccugaugaggccguuaggccgaangggcggg

SEQ ID NO: 5541 - RNA, 38 nt, Artificial Sequence
  Description of Artificial Sequence:  Enzymatic Nucleic Acid
  misc_feature (31)..(31): n stands for inosine
gagagguacugaugaggccguuaggccgaancaggggc

SEQ ID NO: 5542 - RNA, 38 nt, Artificial Sequence
  Description of Artificial Sequence:  Enzymatic Nucleic Acid
  misc_feature (31)..(31): n stands for inosine
ggagaggucugaugaggccguuaggccgaangcagggg

SEQ ID NO: 5543 - RNA, 38 nt, Artificial Sequence
  Description of Artificial Sequence:  Enzymatic Nucleic Acid
  misc_feature (31)..(31): n stands for inosine
agaggagacugaugaggccguuaggccgaanuaggcag

SEQ ID NO: 5544 - RNA, 38 nt, Artificial Sequence
  Description of Artificial Sequence:  Enzymatic Nucleic Acid
  misc_feature (31)..(31): n stands for inosine
gagaggagcugaugaggccguuaggccgaanguaggca

SEQ ID NO: 5545 - RNA, 38 nt, Artificial Sequence
  Description of Artificial Sequence:  Enzymatic Nucleic Acid
  misc_feature (31)..(31): n stands for inosine
gggagaggcugaugaggccguuaggccgaanagguagg

SEQ ID NO: 5546 - RNA, 38 nt, Artificial Sequence
  Description of Artificial Sequence:  Enzymatic Nucleic Acid
  misc_feature (31)..(31): n stands for inosine
aggggagacugaugaggccguuaggccgaanagaggua

SEQ ID NO: 5547 - RNA, 38 nt, Artificial Sequence
  Description of Artificial Sequence:  Enzymatic Nucleic Acid
  misc_feature (31)..(31): n stands for inosine
caggggagcugaugaggccguuaggccgaangagaggu

SEQ ID NO: 5548 - RNA, 38 nt, Artificial Sequence
  Description of Artificial Sequence:  Enzymatic Nucleic Acid
  misc_feature (31)..(31): n stands for inosine
gccaggggcugaugaggccguuaggccgaanaggagag

SEQ ID NO: 5549 - RNA, 38 nt, Artificial Sequence
  Description of Artificial Sequence:  Enzymatic Nucleic Acid
  misc_feature (31)..(31): n stands for inosine
gggccaggcugaugaggccguuaggccgaanagaggag

SEQ ID NO: 5550 - RNA, 38 nt, Artificial Sequence
  Description of Artificial Sequence:  Enzymatic Nucleic Acid
  misc_feature (31)..(31): n stands for inosine
agggccagcugaugaggccguuaggccgaangagagga

SEQ ID NO: 5551 - RNA, 38 nt, Artificial Sequence
  Description of Artificial Sequence:  Enzymatic Nucleic Acid
  misc_feature (31)..(31): n stands for inosine
cagggccacugaugaggccguuaggccgaanggagagg

SEQ ID NO: 5552 - RNA, 38 nt, Artificial Sequence
  Description of Artificial Sequence:  Enzymatic Nucleic Acid
  misc_feature (31)..(31): n stands for inosine
gcagggcccugaugaggccguuaggccgaangggagag

SEQ ID NO: 5553 - RNA, 38 nt, Artificial Sequence
  Description of Artificial Sequence:  Enzymatic Nucleic Acid
  misc_feature (31)..(31): n stands for inosine
cugggcagcugaugaggccguuaggccgaanccagggg

SEQ ID NO: 5554 - RNA, 38 nt, Artificial Sequence
  Description of Artificial Sequence:  Enzymatic Nucleic Acid
  misc_feature (31)..(31): n stands for inosine
gcugggcacugaugaggccguuaggccgaangccaggg

SEQ ID NO: 5555 - RNA, 38 nt, Artificial Sequence
  Description of Artificial Sequence:  Enzymatic Nucleic Acid
  misc_feature (31)..(31): n stands for inosine
ggcugggccugaugaggccguuaggccgaanggccagg

SEQ ID NO: 5556 - RNA, 38 nt, Artificial Sequence
  Description of Artificial Sequence:  Enzymatic Nucleic Acid
  misc_feature (31)..(31): n stands for inosine
ucuggcugcugaugaggccguuaggccgaancagggcc

SEQ ID NO: 5557 - RNA, 38 nt, Artificial Sequence
  Description of Artificial Sequence:  Enzymatic Nucleic Acid
  misc_feature (31)..(31): n stands for inosine
cucuggcucugaugaggccguuaggccgaangcagggc

SEQ ID NO: 5558 - RNA, 38 nt, Artificial Sequence
  Description of Artificial Sequence:  Enzymatic Nucleic Acid
  misc_feature (31)..(31): n stands for inosine
ccucuggccugaugaggccguuaggccgaanggcaggg

SEQ ID NO: 5559 - RNA, 38 nt, Artificial Sequence
  Description of Artificial Sequence:  Enzymatic Nucleic Acid
  misc_feature (31)..(31): n stands for inosine
ccuccucucugaugaggccguuaggccgaancugggca

SEQ ID NO: 5560 - RNA, 38 nt, Artificial Sequence
  Description of Artificial Sequence:  Enzymatic Nucleic Acid
  misc_feature (31)..(31): n stands for inosine
uccuccuccugaugaggccguuaggccgaangcugggc

SEQ ID NO: 5561 - RNA, 38 nt, Artificial Sequence
  Description of Artificial Sequence:  Enzymatic Nucleic Acid
  misc_feature (31)..(31): n stands for inosine
cucgggggcugaugaggccguuaggccgaancuccucc

SEQ ID NO: 5562 - RNA, 38 nt, Artificial Sequence
  Description of Artificial Sequence:  Enzymatic Nucleic Acid
  misc_feature (31)..(31): n stands for inosine
ccucggggcugaugaggccguuaggccgaangcuccuc

SEQ ID NO: 5563 - RNA, 38 nt, Artificial Sequence
  Description of Artificial Sequence:  Enzymatic Nucleic Acid
  misc_feature (31)..(31): n stands for inosine
uccucgggcugaugaggccguuaggccgaanggcuccu

SEQ ID NO: 5564 - RNA, 38 nt, Artificial Sequence
  Description of Artificial Sequence:  Enzymatic Nucleic Acid
  misc_feature (31)..(31): n stands for inosine
cuccucggcugaugaggccguuaggccgaangggcucc

SEQ ID NO: 5565 - RNA, 38 nt, Artificial Sequence
  Description of Artificial Sequence:  Enzymatic Nucleic Acid
  misc_feature (31)..(31): n stands for inosine
gcuccucgcugaugaggccguuaggccgaanggggcuc

SEQ ID NO: 5566 - RNA, 38 nt, Artificial Sequence
  Description of Artificial Sequence:  Enzymatic Nucleic Acid
  misc_feature (31)..(31): n stands for inosine
ggcuccuccugaugaggccguuaggccgaangggggcu

SEQ ID NO: 5567 - RNA, 38 nt, Artificial Sequence
  Description of Artificial Sequence:  Enzymatic Nucleic Acid
  misc_feature (31)..(31): n stands for inosine
agucaggucugaugaggccguuaggccgaancuccucg

SEQ ID NO: 5568 - RNA, 38 nt, Artificial Sequence
  Description of Artificial Sequence:  Enzymatic Nucleic Acid
  misc_feature (31)..(31): n stands for inosine
aagucaggcugaugaggccguuaggccgaangcuccuc

SEQ ID NO: 5569 - RNA, 38 nt, Artificial Sequence
  Description of Artificial Sequence:  Enzymatic Nucleic Acid
  misc_feature (31)..(31): n stands for inosine
agaagucacugaugaggccguuaggccgaanuggcucc

SEQ ID NO: 5570 - RNA, 38 nt, Artificial Sequence
  Description of Artificial Sequence:  Enzymatic Nucleic Acid
  misc_feature (31)..(31): n stands for inosine
cagaaguccugaugaggccguuaggccgaanguggcuc

SEQ ID NO: 5571 - RNA, 38 nt, Artificial Sequence
  Description of Artificial Sequence:  Enzymatic Nucleic Acid
  misc_feature (31)..(31): n stands for inosine
acagcagacugaugaggccguuaggccgaanucaggug

SEQ ID NO: 5572 - RNA, 38 nt, Artificial Sequence
  Description of Artificial Sequence:  Enzymatic Nucleic Acid
  misc_feature (31)..(31): n stands for inosine
gggacagccugaugaggccguuaggccgaanaagucag

SEQ ID NO: 5573 - RNA, 38 nt, Artificial Sequence
  Description of Artificial Sequence:  Enzymatic Nucleic Acid
  misc_feature (31)..(31): n stands for inosine
cuugggaccugaugaggccguuaggccgaancagaagu

SEQ ID NO: 5574 - RNA, 38 nt, Artificial Sequence
  Description of Artificial Sequence:  Enzymatic Nucleic Acid
  misc_feature (31)..(31): n stands for inosine
ggcacuugcugaugaggccguuaggccgaanacagcag

SEQ ID NO: 5575 - RNA, 38 nt, Artificial Sequence
  Description of Artificial Sequence:  Enzymatic Nucleic Acid
  misc_feature (31)..(31): n stands for inosine
uggcacuucugaugaggccguuaggccgaangacagca

SEQ ID NO: 5576 - RNA, 38 nt, Artificial Sequence
  Description of Artificial Sequence:  Enzymatic Nucleic Acid
  misc_feature (31)..(31): n stands for inosine
cuggcacucugaugaggccguuaggccgaanggacagc

SEQ ID NO: 5577 - RNA, 38 nt, Artificial Sequence
  Description of Artificial Sequence:  Enzymatic Nucleic Acid
  misc_feature (31)..(31): n stands for inosine
cugauacucugaugaggccguuaggccgaancacuugg

SEQ ID NO: 5578 - RNA, 38 nt, Artificial Sequence
  Description of Artificial Sequence:  Enzymatic Nucleic Acid
  misc_feature (31)..(31): n stands for inosine
ccugauaccugaugaggccguuaggccgaangcacuug

SEQ ID NO: 5579 - RNA, 38 nt, Artificial Sequence
  Description of Artificial Sequence:  Enzymatic Nucleic Acid
  misc_feature (31)..(31): n stands for inosine
caggggcccugaugaggccguuaggccgaanauacugg

SEQ ID NO: 5580 - RNA, 38 nt, Artificial Sequence
  Description of Artificial Sequence:  Enzymatic Nucleic Acid
  misc_feature (31)..(31): n stands for inosine
auaucaggcugaugaggccguuaggccgaanccugaua

SEQ ID NO: 5581 - RNA, 38 nt, Artificial Sequence
  Description of Artificial Sequence:  Enzymatic Nucleic Acid
  misc_feature (31)..(31): n stands for inosine
cauaucagcugaugaggccguuaggccgaangccugau

SEQ ID NO: 5582 - RNA, 38 nt, Artificial Sequence
  Description of Artificial Sequence:  Enzymatic Nucleic Acid
  misc_feature (31)..(31): n stands for inosine
ccauaucacugaugaggccguuaggccgaanggccuga

SEQ ID NO: 5583 - RNA, 38 nt, Artificial Sequence
  Description of Artificial Sequence:  Enzymatic Nucleic Acid
  misc_feature (31)..(31): n stands for inosine
uccauauccugaugaggccguuaggccgaangggccug

SEQ ID NO: 5584 - RNA, 38 nt, Artificial Sequence
  Description of Artificial Sequence:  Enzymatic Nucleic Acid
  misc_feature (31)..(31): n stands for inosine
cugcagggcugaugaggccguuaggccgaanuccauau

SEQ ID NO: 5585 - RNA, 38 nt, Artificial Sequence
  Description of Artificial Sequence:  Enzymatic Nucleic Acid
  misc_feature (31)..(31): n stands for inosine
aucugcagcugaugaggccguuaggccgaanuguccau

SEQ ID NO: 5586 - RNA, 38 nt, Artificial Sequence
  Description of Artificial Sequence:  Enzymatic Nucleic Acid
  misc_feature (31)..(31): n stands for inosine
uaucugcacugaugaggccguuaggccgaangugucca

SEQ ID NO: 5587 - RNA, 38 nt, Artificial Sequence
  Description of Artificial Sequence:  Enzymatic Nucleic Acid
  misc_feature (31)..(31): n stands for inosine
guaucugccugaugaggccguuaggccgaanggugucc

SEQ ID NO: 5588 - RNA, 38 nt, Artificial Sequence
  Description of Artificial Sequence:  Enzymatic Nucleic Acid
  misc_feature (31)..(31): n stands for inosine
cauguauccugaugaggccguuaggccgaancagggug

SEQ ID NO: 5589 - RNA, 38 nt, Artificial Sequence
  Description of Artificial Sequence:  Enzymatic Nucleic Acid
  misc_feature (31)..(31): n stands for inosine
ccaugacacugaugaggccguuaggccgaanuaucugc

SEQ ID NO: 5590 - RNA, 38 nt, Artificial Sequence
  Description of Artificial Sequence:  Enzymatic Nucleic Acid
  misc_feature (31)..(31): n stands for inosine
gcacuccacugaugaggccguuaggccgaanacaugua

SEQ ID NO: 5591 - RNA, 38 nt, Artificial Sequence
  Description of Artificial Sequence:  Enzymatic Nucleic Acid
  misc_feature (31)..(31): n stands for inosine
cuacucaacugaugaggccguuaggccgaancacucca

SEQ ID NO: 5592 - RNA, 38 nt, Artificial Sequence
  Description of Artificial Sequence:  Enzymatic Nucleic Acid
  misc_feature (31)..(31): n stands for inosine
cacuggcccugaugaggccguuaggccgaancccuacu

SEQ ID NO: 5593 - RNA, 38 nt, Artificial Sequence
  Description of Artificial Sequence:  Enzymatic Nucleic Acid
  misc_feature (31)..(31): n stands for inosine
cuugcacucugaugaggccguuaggccgaanccggccc

SEQ ID NO: 5594 - RNA, 38 nt, Artificial Sequence
  Description of Artificial Sequence:  Enzymatic Nucleic Acid
  misc_feature (31)..(31): n stands for inosine
ccuugcaccugaugaggccguuaggccgaangccggcc

SEQ ID NO: 5595 - RNA, 38 nt, Artificial Sequence
  Description of Artificial Sequence:  Enzymatic Nucleic Acid
  misc_feature (31)..(31): n stands for inosine
aguggccucugaugaggccguuaggccgaancacuggc

SEQ ID NO: 5596 - RNA, 38 nt, Artificial Sequence
  Description of Artificial Sequence:  Enzymatic Nucleic Acid
  misc_feature (31)..(31): n stands for inosine
caggcagucugaugaggccguuaggccgaanccuugca

SEQ ID NO: 5597 - RNA, 38 nt, Artificial Sequence
  Description of Artificial Sequence:  Enzymatic Nucleic Acid
  misc_feature (31)..(31): n stands for inosine
gcaggcagcugaugaggccguuaggccgaangccuugc

SEQ ID NO: 5598 - RNA, 38 nt, Artificial Sequence
  Description of Artificial Sequence:  Enzymatic Nucleic Acid
  misc_feature (31)..(31): n stands for inosine
gggcaggccugaugaggccguuaggccgaanuggccuu

SEQ ID NO: 5599 - RNA, 38 nt, Artificial Sequence
  Description of Artificial Sequence:  Enzymatic Nucleic Acid
  misc_feature (31)..(31): n stands for inosine
cucgggcacugaugaggccguuaggccgaancaguggc

SEQ ID NO: 5600 - RNA, 38 nt, Artificial Sequence
  Description of Artificial Sequence:  Enzymatic Nucleic Acid
  misc_feature (31)..(31): n stands for inosine
ccucgggccugaugaggccguuaggccgaangcagugg

SEQ ID NO: 5601 - RNA, 38 nt, Artificial Sequence
  Description of Artificial Sequence:  Enzymatic Nucleic Acid
  misc_feature (31)..(31): n stands for inosine
cguccucgcugaugaggccguuaggccgaancaggcag

SEQ ID NO: 5602 - RNA, 38 nt, Artificial Sequence
  Description of Artificial Sequence:  Enzymatic Nucleic Acid
  misc_feature (31)..(31): n stands for inosine
acguccuccugaugaggccguuaggccgaangcaggca

SEQ ID NO: 5603 - RNA, 38 nt, Artificial Sequence
  Description of Artificial Sequence:  Enzymatic Nucleic Acid
  misc_feature (31)..(31): n stands for inosine
cggucccgcugaugaggccguuaggccgaancacgucc

SEQ ID NO: 5604 - RNA, 38 nt, Artificial Sequence
  Description of Artificial Sequence:  Enzymatic Nucleic Acid
  misc_feature (31)..(31): n stands for inosine
acgguccccugaugaggccguuaggccgaangcacguc

SEQ ID NO: 5605 - RNA, 38 nt, Artificial Sequence
  Description of Artificial Sequence:  Enzymatic Nucleic Acid
  misc_feature (31)..(31): n stands for inosine
gacugcaccugaugaggccguuaggccgaanucccggg

SEQ ID NO: 5606 - RNA, 38 nt, Artificial Sequence
  Description of Artificial Sequence:  Enzymatic Nucleic Acid
  misc_feature (31)..(31): n stands for inosine
gcgcagaccugaugaggccguuaggccgaancacgguc

SEQ ID NO: 5607 - RNA, 38 nt, Artificial Sequence
  Description of Artificial Sequence:  Enzymatic Nucleic Acid
  misc_feature (31)..(31): n stands for inosine
gaaagcgccugaugaggccguuaggccgaanacugcac

SEQ ID NO: 5608 - RNA, 38 nt, Artificial Sequence
  Description of Artificial Sequence:  Enzymatic Nucleic Acid
  misc_feature (31)..(31): n stands for inosine
gagaggaacugaugaggccguuaggccgaancgcagac

SEQ ID NO: 5609 - RNA, 38 nt, Artificial Sequence
  Description of Artificial Sequence:  Enzymatic Nucleic Acid
  misc_feature (31)..(31): n stands for inosine
gcgggagacugaugaggccguuaggccgaanaaagcgc

SEQ ID NO: 5610 - RNA, 38 nt, Artificial Sequence
  Description of Artificial Sequence:  Enzymatic Nucleic Acid
  misc_feature (31)..(31): n stands for inosine
ggcgggagcugaugaggccguuaggccgaangaaagcg

SEQ ID NO: 5611 - RNA, 38 nt, Artificial Sequence
  Description of Artificial Sequence:  Enzymatic Nucleic Acid
  misc_feature (31)..(31): n stands for inosine
caggcgggcugaugaggccguuaggccgaanaggaaag

SEQ ID NO: 5612 - RNA, 38 nt, Artificial Sequence
  Description of Artificial Sequence:  Enzymatic Nucleic Acid
  misc_feature (31)..(31): n stands for inosine
ggcaggcgcugaugaggccguuaggccgaanagaggaa

SEQ ID NO: 5613 - RNA, 38 nt, Artificial Sequence
  Description of Artificial Sequence:  Enzymatic Nucleic Acid
  misc_feature (31)..(31): n stands for inosine
aggcaggccugaugaggccguuaggccgaangagagga

SEQ ID NO: 5614 - RNA, 38 nt, Artificial Sequence
  Description of Artificial Sequence:  Enzymatic Nucleic Acid
  misc_feature (31)..(31): n stands for inosine
gcuaggcacugaugaggccguuaggccgaancgggaga

SEQ ID NO: 5615 - RNA, 38 nt, Artificial Sequence
  Description of Artificial Sequence:  Enzymatic Nucleic Acid
  misc_feature (31)..(31): n stands for inosine
ggcuaggccugaugaggccguuaggccgaangcgggag

SEQ ID NO: 5616 - RNA, 38 nt, Artificial Sequence
  Description of Artificial Sequence:  Enzymatic Nucleic Acid
  misc_feature (31)..(31): n stands for inosine
cugggcuacugaugaggccguuaggccgaancaggcgg

SEQ ID NO: 5617 - RNA, 38 nt, Artificial Sequence
  Description of Artificial Sequence:  Enzymatic Nucleic Acid
  misc_feature (31)..(31): n stands for inosine
ccugggcucugaugaggccguuaggccgaangcaggcg

SEQ ID NO: 5618 - RNA, 38 nt, Artificial Sequence
  Description of Artificial Sequence:  Enzymatic Nucleic Acid
  misc_feature (31)..(31): n stands for inosine
ucauccugcugaugaggccguuaggccgaancuaggca

SEQ ID NO: 5619 - RNA, 38 nt, Artificial Sequence
  Description of Artificial Sequence:  Enzymatic Nucleic Acid
  misc_feature (31)..(31): n stands for inosine
uucauccucugaugaggccguuaggccgaangcuaggc

SEQ ID NO: 5620 - RNA, 38 nt, Artificial Sequence
  Description of Artificial Sequence:  Enzymatic Nucleic Acid
  misc_feature (31)..(31): n stands for inosine
cuucaucccugaugaggccguuaggccgaanggcuagg

SEQ ID NO: 5621 - RNA, 38 nt, Artificial Sequence
  Description of Artificial Sequence:  Enzymatic Nucleic Acid
  misc_feature (31)..(31): n stands for inosine
ggccaccccugaugaggccguuaggccgaancccuuca

SEQ ID NO: 5622 - RNA, 38 nt, Artificial Sequence
  Description of Artificial Sequence:  Enzymatic Nucleic Acid
  misc_feature (31)..(31): n stands for inosine
ccaguugucugaugaggccguuaggccgaanccaccca

SEQ ID NO: 5623 - RNA, 38 nt, Artificial Sequence
  Description of Artificial Sequence:  Enzymatic Nucleic Acid
  misc_feature (31)..(31): n stands for inosine
cccaguugcugaugaggccguuaggccgaangccaccc

SEQ ID NO: 5624 - RNA, 38 nt, Artificial Sequence
  Description of Artificial Sequence:  Enzymatic Nucleic Acid
  misc_feature (31)..(31): n stands for inosine
aucccagucugaugaggccguuaggccgaanuggccac

SEQ ID NO: 5625 - RNA, 38 nt, Artificial Sequence
  Description of Artificial Sequence:  Enzymatic Nucleic Acid
  misc_feature (31)..(31): n stands for inosine
ggcauccccugaugaggccguuaggccgaanuuguggc

SEQ ID NO: 5626 - RNA, 38 nt, Artificial Sequence
  Description of Artificial Sequence:  Enzymatic Nucleic Acid
  misc_feature (31)..(31): n stands for inosine
cuccaggucugaugaggccguuaggccgaancauccca

SEQ ID NO: 5627 - RNA, 38 nt, Artificial Sequence
  Description of Artificial Sequence:  Enzymatic Nucleic Acid
  misc_feature (31)..(31): n stands for inosine
gcuccaggcugaugaggccguuaggccgaangcauccc

SEQ ID NO: 5628 - RNA, 38 nt, Artificial Sequence
  Description of Artificial Sequence:  Enzymatic Nucleic Acid
  misc_feature (31)..(31): n stands for inosine
gggcuccacugaugaggccguuaggccgaanuggcauc

SEQ ID NO: 5629 - RNA, 38 nt, Artificial Sequence
  Description of Artificial Sequence:  Enzymatic Nucleic Acid
  misc_feature (31)..(31): n stands for inosine
ggggcucccugaugaggccguuaggccgaanguggcau

SEQ ID NO: 5630 - RNA, 38 nt, Artificial Sequence
  Description of Artificial Sequence:  Enzymatic Nucleic Acid
  misc_feature (31)..(31): n stands for inosine
cuggguggcugaugaggccguuaggccgaancuccagg

SEQ ID NO: 5631 - RNA, 38 nt, Artificial Sequence
  Description of Artificial Sequence:  Enzymatic Nucleic Acid
  misc_feature (31)..(31): n stands for inosine
ccugggugcugaugaggccguuaggccgaangcuccag

SEQ ID NO: 5632 - RNA, 38 nt, Artificial Sequence
  Description of Artificial Sequence:  Enzymatic Nucleic Acid
  misc_feature (31)..(31): n stands for inosine
uccugggucugaugaggccguuaggccgaanggcucca

SEQ ID NO: 5633 - RNA, 38 nt, Artificial Sequence
  Description of Artificial Sequence:  Enzymatic Nucleic Acid
  misc_feature (31)..(31): n stands for inosine
cuccugggcugaugaggccguuaggccgaangggcucc

SEQ ID NO: 5634 - RNA, 38 nt, Artificial Sequence
  Description of Artificial Sequence:  Enzymatic Nucleic Acid
  misc_feature (31)..(31): n stands for inosine
agcuccugcugaugaggccguuaggccgaanuggggcu

SEQ ID NO: 5635 - RNA, 38 nt, Artificial Sequence
  Description of Artificial Sequence:  Enzymatic Nucleic Acid
  misc_feature (31)..(31): n stands for inosine
cagcuccucugaugaggccguuaggccgaanguggggc

SEQ ID NO: 5636 - RNA, 38 nt, Artificial Sequence
  Description of Artificial Sequence:  Enzymatic Nucleic Acid
  misc_feature (31)..(31): n stands for inosine
ccagcucccugaugaggccguuaggccgaanggugggg

SEQ ID NO: 5637 - RNA, 38 nt, Artificial Sequence
  Description of Artificial Sequence:  Enzymatic Nucleic Acid
  misc_feature (31)..(31): n stands for inosine
ccgcggcccugaugaggccguuaggccgaancuccugg

SEQ ID NO: 5638 - RNA, 38 nt, Artificial Sequence
  Description of Artificial Sequence:  Enzymatic Nucleic Acid
  misc_feature (31)..(31): n stands for inosine
ggugccgccugaugaggccguuaggccgaanccagcuc

SEQ ID NO: 5639 - RNA, 38 nt, Artificial Sequence
  Description of Artificial Sequence:  Enzymatic Nucleic Acid
  misc_feature (31)..(31): n stands for inosine
gcguaaggcugaugaggccguuaggccgaanccgcggc

SEQ ID NO: 5640 - RNA, 38 nt, Artificial Sequence
  Description of Artificial Sequence:  Enzymatic Nucleic Acid
  misc_feature (31)..(31): n stands for inosine
aagcguaacugaugaggccguuaggccgaanugccgcg

SEQ ID NO: 5641 - RNA, 38 nt, Artificial Sequence
  Description of Artificial Sequence:  Enzymatic Nucleic Acid
  misc_feature (31)..(31): n stands for inosine
gaagcguacugaugaggccguuaggccgaangugccgc

SEQ ID NO: 5642 - RNA, 38 nt, Artificial Sequence
  Description of Artificial Sequence:  Enzymatic Nucleic Acid
  misc_feature (31)..(31): n stands for inosine
acagcugacugaugaggccguuaggccgaancguaagg

SEQ ID NO: 5643 - RNA, 38 nt, Artificial Sequence
  Description of Artificial Sequence:  Enzymatic Nucleic Acid
  misc_feature (31)..(31): n stands for inosine
ucaacagccugaugaggccguuaggccgaanaagcgua

SEQ ID NO: 5644 - RNA, 38 nt, Artificial Sequence
  Description of Artificial Sequence:  Enzymatic Nucleic Acid
  misc_feature (31)..(31): n stands for inosine
ggaucaaccugaugaggccguuaggccgaancugaagc

SEQ ID NO: 5645 - RNA, 38 nt, Artificial Sequence
  Description of Artificial Sequence:  Enzymatic Nucleic Acid
  misc_feature (31)..(31): n stands for inosine
ggaccagccugaugaggccguuaggccgaanaucaaca

SEQ ID NO: 5646 - RNA, 38 nt, Artificial Sequence
  Description of Artificial Sequence:  Enzymatic Nucleic Acid
  misc_feature (31)..(31): n stands for inosine
aggggacccugaugaggccguuaggccgaancggauca

SEQ ID NO: 5647 - RNA, 38 nt, Artificial Sequence
  Description of Artificial Sequence:  Enzymatic Nucleic Acid
  misc_feature (31)..(31): n stands for inosine
aaaagaggcugaugaggccguuaggccgaanaccagcg

SEQ ID NO: 5648 - RNA, 38 nt, Artificial Sequence
  Description of Artificial Sequence:  Enzymatic Nucleic Acid
  misc_feature (31)..(31): n stands for inosine
caaaagagcugaugaggccguuaggccgaangaccagc

SEQ ID NO: 5649 - RNA, 38 nt, Artificial Sequence
  Description of Artificial Sequence:  Enzymatic Nucleic Acid
  misc_feature (31)..(31): n stands for inosine
ccaaaagacugaugaggccguuaggccgaanggaccag

SEQ ID NO: 5650 - RNA, 38 nt, Artificial Sequence
  Description of Artificial Sequence:  Enzymatic Nucleic Acid
  misc_feature (31)..(31): n stands for inosine
cccaaaagcugaugaggccguuaggccgaangggacca

SEQ ID NO: 5651 - RNA, 38 nt, Artificial Sequence
  Description of Artificial Sequence:  Enzymatic Nucleic Acid
  misc_feature (31)..(31): n stands for inosine
accccaaacugaugaggccguuaggccgaanaggggac

SEQ ID NO: 5652 - RNA, 38 nt, Artificial Sequence
  Description of Artificial Sequence:  Enzymatic Nucleic Acid
  misc_feature (31)..(31): n stands for inosine
cugaucggcugaugaggccguuaggccgaanccgcauc

SEQ ID NO: 5653 - RNA, 38 nt, Artificial Sequence
  Description of Artificial Sequence:  Enzymatic Nucleic Acid
  misc_feature (31)..(31): n stands for inosine
ccugaucgcugaugaggccguuaggccgaangccgcau

SEQ ID NO: 5654 - RNA, 38 nt, Artificial Sequence
  Description of Artificial Sequence:  Enzymatic Nucleic Acid
  misc_feature (31)..(31): n stands for inosine
gccugauccugaugaggccguuaggccgaanggccgca

SEQ ID NO: 5655 - RNA, 38 nt, Artificial Sequence
  Description of Artificial Sequence:  Enzymatic Nucleic Acid
  misc_feature (31)..(31): n stands for inosine
gucaggcccugaugaggccguuaggccgaanaucgggg

SEQ ID NO: 5656 - RNA, 38 nt, Artificial Sequence
  Description of Artificial Sequence:  Enzymatic Nucleic Acid
  misc_feature (31)..(31): n stands for inosine
gcgagucacugaugaggccguuaggccgaanccugauc

SEQ ID NO: 5657 - RNA, 38 nt, Artificial Sequence
  Description of Artificial Sequence:  Enzymatic Nucleic Acid
  misc_feature (31)..(31): n stands for inosine
agcgaguccugaugaggccguuaggccgaangccugau

SEQ ID NO: 5658 - RNA, 38 nt, Artificial Sequence
  Description of Artificial Sequence:  Enzymatic Nucleic Acid
  misc_feature (31)..(31): n stands for inosine
gagcagcgcugaugaggccguuaggccgaanucaggcc

SEQ ID NO: 5659 - RNA, 38 nt, Artificial Sequence
  Description of Artificial Sequence:  Enzymatic Nucleic Acid
  misc_feature (31)..(31): n stands for inosine
aaaagagccugaugaggccguuaggccgaancgaguca

SEQ ID NO: 5660 - RNA, 38 nt, Artificial Sequence
  Description of Artificial Sequence:  Enzymatic Nucleic Acid
  misc_feature (31)..(31): n stands for inosine
acaaaaagcugaugaggccguuaggccgaancagcgag

SEQ ID NO: 5661 - RNA, 38 nt, Artificial Sequence
  Description of Artificial Sequence:  Enzymatic Nucleic Acid
  misc_feature (31)..(31): n stands for inosine
gaacaaaacugaugaggccguuaggccgaanagcagcg

SEQ ID NO: 5662 - RNA, 38 nt, Artificial Sequence
  Description of Artificial Sequence:  Enzymatic Nucleic Acid
  misc_feature (31)..(31): n stands for inosine
gacagaagcugaugaggccguuaggccgaanaacaaaa

SEQ ID NO: 5663 - RNA, 38 nt, Artificial Sequence
  Description of Artificial Sequence:  Enzymatic Nucleic Acid
  misc_feature (31)..(31): n stands for inosine
agacagaacugaugaggccguuaggccgaangaacaaa

SEQ ID NO: 5664 - RNA, 38 nt, Artificial Sequence
  Description of Artificial Sequence:  Enzymatic Nucleic Acid
  misc_feature (31)..(31): n stands for inosine
cagacagacugaugaggccguuaggccgaanggaacaa

SEQ ID NO: 5665 - RNA, 38 nt, Artificial Sequence
  Description of Artificial Sequence:  Enzymatic Nucleic Acid
  misc_feature (31)..(31): n stands for inosine
gagcagaccugaugaggccguuaggccgaanaagggaa

SEQ ID NO: 5666 - RNA, 38 nt, Artificial Sequence
  Description of Artificial Sequence:  Enzymatic Nucleic Acid
  misc_feature (31)..(31): n stands for inosine
guucgagccugaugaggccguuaggccgaanacagaag

SEQ ID NO: 5667 - RNA, 38 nt, Artificial Sequence
  Description of Artificial Sequence:  Enzymatic Nucleic Acid
  misc_feature (31)..(31): n stands for inosine
gugguucgcugaugaggccguuaggccgaancagacag

SEQ ID NO: 5668 - RNA, 38 nt, Artificial Sequence
  Description of Artificial Sequence:  Enzymatic Nucleic Acid
  misc_feature (31)..(31): n stands for inosine
aggcaagucugaugaggccguuaggccgaanuucgagc

SEQ ID NO: 5669 - RNA, 38 nt, Artificial Sequence
  Description of Artificial Sequence:  Enzymatic Nucleic Acid
  misc_feature (31)..(31): n stands for inosine
gaggcaagcugaugaggccguuaggccgaanguucgag

SEQ ID NO: 5670 - RNA, 38 nt, Artificial Sequence
  Description of Artificial Sequence:  Enzymatic Nucleic Acid
  misc_feature (31)..(31): n stands for inosine
ccgaggcacugaugaggccguuaggccgaanugguucg

SEQ ID NO: 5671 - RNA, 38 nt, Artificial Sequence
  Description of Artificial Sequence:  Enzymatic Nucleic Acid
  misc_feature (31)..(31): n stands for inosine
uagcccgacugaugaggccguuaggccgaancaagugg

SEQ ID NO: 5672 - RNA, 38 nt, Artificial Sequence
  Description of Artificial Sequence:  Enzymatic Nucleic Acid
  misc_feature (31)..(31): n stands for inosine
uuagcccgcugaugaggccguuaggccgaangcaagug

SEQ ID NO: 5673 - RNA, 38 nt, Artificial Sequence
  Description of Artificial Sequence:  Enzymatic Nucleic Acid
  misc_feature (31)..(31): n stands for inosine
gagggauucugaugaggccguuaggccgaancccgagg

SEQ ID NO: 5674 - RNA, 38 nt, Artificial Sequence
  Description of Artificial Sequence:  Enzymatic Nucleic Acid
  misc_feature (31)..(31): n stands for inosine
agagggagcugaugaggccguuaggccgaanauuagcc

SEQ ID NO: 5675 - RNA, 38 nt, Artificial Sequence
  Description of Artificial Sequence:  Enzymatic Nucleic Acid
  misc_feature (31)..(31): n stands for inosine
aagagggacugaugaggccguuaggccgaangauuagc

SEQ ID NO: 5676 - RNA, 38 nt, Artificial Sequence
  Description of Artificial Sequence:  Enzymatic Nucleic Acid
  misc_feature (31)..(31): n stands for inosine
gaagagggcugaugaggccguuaggccgaanggauuag

SEQ ID NO: 5677 - RNA, 38 nt, Artificial Sequence
  Description of Artificial Sequence:  Enzymatic Nucleic Acid
  misc_feature (31)..(31): n stands for inosine
aggaagagcugaugaggccguuaggccgaanagggauu

SEQ ID NO: 5678 - RNA, 38 nt, Artificial Sequence
  Description of Artificial Sequence:  Enzymatic Nucleic Acid
  misc_feature (31)..(31): n stands for inosine
gaggaagacugaugaggccguuaggccgaangagggau

SEQ ID NO: 5679 - RNA, 38 nt, Artificial Sequence
  Description of Artificial Sequence:  Enzymatic Nucleic Acid
  misc_feature (31)..(31): n stands for inosine
ggaggaagcugaugaggccguuaggccgaanggaggga

SEQ ID NO: 5680 - RNA, 38 nt, Artificial Sequence
  Description of Artificial Sequence:  Enzymatic Nucleic Acid
  misc_feature (31)..(31): n stands for inosine
guggaggacugaugaggccguuaggccgaanagggagg

SEQ ID NO: 5681 - RNA, 38 nt, Artificial Sequence
  Description of Artificial Sequence:  Enzymatic Nucleic Acid
  misc_feature (31)..(31): n stands for inosine
cggguggacugaugaggccguuaggccgaanaagaggg

SEQ ID NO: 5682 - RNA, 38 nt, Artificial Sequence
  Description of Artificial Sequence:  Enzymatic Nucleic Acid
  misc_feature (31)..(31): n stands for inosine
ccggguggcugaugaggccguuaggccgaangaagagg

SEQ ID NO: 5683 - RNA, 38 nt, Artificial Sequence
  Description of Artificial Sequence:  Enzymatic Nucleic Acid
  misc_feature (31)..(31): n stands for inosine
ugccgggucugaugaggccguuaggccgaanaggaaga

SEQ ID NO: 5684 - RNA, 38 nt, Artificial Sequence
  Description of Artificial Sequence:  Enzymatic Nucleic Acid
  misc_feature (31)..(31): n stands for inosine
gugccgggcugaugaggccguuaggccgaangaggaag

SEQ ID NO: 5685 - RNA, 38 nt, Artificial Sequence
  Description of Artificial Sequence:  Enzymatic Nucleic Acid
  misc_feature (31)..(31): n stands for inosine
cagugccgcugaugaggccguuaggccgaanuggagga

SEQ ID NO: 5686 - RNA, 38 nt, Artificial Sequence
  Description of Artificial Sequence:  Enzymatic Nucleic Acid
  misc_feature (31)..(31): n stands for inosine
ccagugcccugaugaggccguuaggccgaanguggagg

SEQ ID NO: 5687 - RNA, 38 nt, Artificial Sequence
  Description of Artificial Sequence:  Enzymatic Nucleic Acid
  misc_feature (31)..(31): n stands for inosine
uuccccagcugaugaggccguuaggccgaanccgggug

SEQ ID NO: 5688 - RNA, 38 nt, Artificial Sequence
  Description of Artificial Sequence:  Enzymatic Nucleic Acid
  misc_feature (31)..(31): n stands for inosine
acuucccccugaugaggccguuaggccgaanugccggg

SEQ ID NO: 5689 - RNA, 38 nt, Artificial Sequence
  Description of Artificial Sequence:  Enzymatic Nucleic Acid
  misc_feature (31)..(31): n stands for inosine
cccauucucugaugaggccguuaggccgaanacuuccc

SEQ ID NO: 5690 - RNA, 38 nt, Artificial Sequence
  Description of Artificial Sequence:  Enzymatic Nucleic Acid
  misc_feature (31)..(31): n stands for inosine
gagccccacugaugaggccguuaggccgaanccccauu

SEQ ID NO: 5691 - RNA, 38 nt, Artificial Sequence
  Description of Artificial Sequence:  Enzymatic Nucleic Acid
  misc_feature (31)..(31): n stands for inosine
agagcccccugaugaggccguuaggccgaangccccau

SEQ ID NO: 5692 - RNA, 38 nt, Artificial Sequence
  Description of Artificial Sequence:  Enzymatic Nucleic Acid
  misc_feature (31)..(31): n stands for inosine
ucccugagcugaugaggccguuaggccgaanccccagg

SEQ ID NO: 5693 - RNA, 38 nt, Artificial Sequence
  Description of Artificial Sequence:  Enzymatic Nucleic Acid
  misc_feature (31)..(31): n stands for inosine
ucucccugcugaugaggccguuaggccgaanagcccca

SEQ ID NO: 5694 - RNA, 38 nt, Artificial Sequence
  Description of Artificial Sequence:  Enzymatic Nucleic Acid
  misc_feature (31)..(31): n stands for inosine
guucuccccugaugaggccguuaggccgaanagagccc

SEQ ID NO: 5695 - RNA, 38 nt, Artificial Sequence
  Description of Artificial Sequence:  Enzymatic Nucleic Acid
  misc_feature (31)..(31): n stands for inosine
ggggaagccugaugaggccguuaggccgaanuucuccc

SEQ ID NO: 5696 - RNA, 38 nt, Artificial Sequence
  Description of Artificial Sequence:  Enzymatic Nucleic Acid
  misc_feature (31)..(31): n stands for inosine
ccaggggacugaugaggccguuaggccgaancaguucu

SEQ ID NO: 5697 - RNA, 38 nt, Artificial Sequence
  Description of Artificial Sequence:  Enzymatic Nucleic Acid
  misc_feature (31)..(31): n stands for inosine
cugccaggcugaugaggccguuaggccgaanaagcagu

SEQ ID NO: 5698 - RNA, 38 nt, Artificial Sequence
  Description of Artificial Sequence:  Enzymatic Nucleic Acid
  misc_feature (31)..(31): n stands for inosine
ucugccagcugaugaggccguuaggccgaangaagcag

SEQ ID NO: 5699 - RNA, 38 nt, Artificial Sequence
  Description of Artificial Sequence:  Enzymatic Nucleic Acid
  misc_feature (31)..(31): n stands for inosine
cucugccacugaugaggccguuaggccgaanggaagca

SEQ ID NO: 5700 - RNA, 38 nt, Artificial Sequence
  Description of Artificial Sequence:  Enzymatic Nucleic Acid
  misc_feature (31)..(31): n stands for inosine
gcucugcccugaugaggccguuaggccgaangggaagc

SEQ ID NO: 5701 - RNA, 38 nt, Artificial Sequence
  Description of Artificial Sequence:  Enzymatic Nucleic Acid
  misc_feature (31)..(31): n stands for inosine
cccagcuccugaugaggccguuaggccgaanccagggg

SEQ ID NO: 5702 - RNA, 38 nt, Artificial Sequence
  Description of Artificial Sequence:  Enzymatic Nucleic Acid
  misc_feature (31)..(31): n stands for inosine
ugccaccccugaugaggccguuaggccgaancucugcc

SEQ ID NO: 5703 - RNA, 38 nt, Artificial Sequence
  Description of Artificial Sequence:  Enzymatic Nucleic Acid
  misc_feature (31)..(31): n stands for inosine
ggaagagccugaugaggccguuaggccgaanccaccca

SEQ ID NO: 5704 - RNA, 38 nt, Artificial Sequence
  Description of Artificial Sequence:  Enzymatic Nucleic Acid
  misc_feature (31)..(31): n stands for inosine
ggaggaagcugaugaggccguuaggccgaancugccac

SEQ ID NO: 5705 - RNA, 38 nt, Artificial Sequence
  Description of Artificial Sequence:  Enzymatic Nucleic Acid
  misc_feature (31)..(31): n stands for inosine
ugggaggacugaugaggccguuaggccgaanagcugcc

SEQ ID NO: 5706 - RNA, 38 nt, Artificial Sequence
  Description of Artificial Sequence:  Enzymatic Nucleic Acid
  misc_feature (31)..(31): n stands for inosine
cggugggacugaugaggccguuaggccgaanaagagcu

SEQ ID NO: 5707 - RNA, 38 nt, Artificial Sequence
  Description of Artificial Sequence:  Enzymatic Nucleic Acid
  misc_feature (31)..(31): n stands for inosine
ccggugggcugaugaggccguuaggccgaangaagagc

SEQ ID NO: 5708 - RNA, 38 nt, Artificial Sequence
  Description of Artificial Sequence:  Enzymatic Nucleic Acid
  misc_feature (31)..(31): n stands for inosine
guccggugcugaugaggccguuaggccgaanaggaaga

SEQ ID NO: 5709 - RNA, 38 nt, Artificial Sequence
  Description of Artificial Sequence:  Enzymatic Nucleic Acid
  misc_feature (31)..(31): n stands for inosine
uguccggucugaugaggccguuaggccgaangaggaag

SEQ ID NO: 5710 - RNA, 38 nt, Artificial Sequence
  Description of Artificial Sequence:  Enzymatic Nucleic Acid
  misc_feature (31)..(31): n stands for inosine
guguccggcugaugaggccguuaggccgaanggaggaa

SEQ ID NO: 5711 - RNA, 38 nt, Artificial Sequence
  Description of Artificial Sequence:  Enzymatic Nucleic Acid
  misc_feature (31)..(31): n stands for inosine
cggugucccugaugaggccguuaggccgaanugggagg

SEQ ID NO: 5712 - RNA, 38 nt, Artificial Sequence
  Description of Artificial Sequence:  Enzymatic Nucleic Acid
  misc_feature (31)..(31): n stands for inosine
cgggucggcugaugaggccguuaggccgaanuccggug

SEQ ID NO: 5713 - RNA, 38 nt, Artificial Sequence
  Description of Artificial Sequence:  Enzymatic Nucleic Acid
  misc_feature (31)..(31): n stands for inosine
ggcggguccugaugaggccguuaggccgaanuguccgg

SEQ ID NO: 5714 - RNA, 38 nt, Artificial Sequence
  Description of Artificial Sequence:  Enzymatic Nucleic Acid
  misc_feature (31)..(31): n stands for inosine
ggcgggcgcugaugaggccguuaggccgaanucggugu

SEQ ID NO: 5715 - RNA, 38 nt, Artificial Sequence
  Description of Artificial Sequence:  Enzymatic Nucleic Acid
  misc_feature (31)..(31): n stands for inosine
cggcgggccugaugaggccguuaggccgaangucggug

SEQ ID NO: 5716 - RNA, 38 nt, Artificial Sequence
  Description of Artificial Sequence:  Enzymatic Nucleic Acid
  misc_feature (31)..(31): n stands for inosine
cagcggcgcugaugaggccguuaggccgaancgggucg

SEQ ID NO: 5717 - RNA, 38 nt, Artificial Sequence
  Description of Artificial Sequence:  Enzymatic Nucleic Acid
  misc_feature (31)..(31): n stands for inosine
acagcggccugaugaggccguuaggccgaangcggguc

SEQ ID NO: 5718 - RNA, 38 nt, Artificial Sequence
  Description of Artificial Sequence:  Enzymatic Nucleic Acid
  misc_feature (31)..(31): n stands for inosine
ggcacagccugaugaggccguuaggccgaancgggcgg

SEQ ID NO: 5719 - RNA, 38 nt, Artificial Sequence
  Description of Artificial Sequence:  Enzymatic Nucleic Acid
  misc_feature (31)..(31): n stands for inosine
cagggcaccugaugaggccguuaggccgaancggcggg

SEQ ID NO: 5720 - RNA, 38 nt, Artificial Sequence
  Description of Artificial Sequence:  Enzymatic Nucleic Acid
  misc_feature (31)..(31): n stands for inosine
acucccagcugaugaggccguuaggccgaancacagcg

SEQ ID NO: 5721 - RNA, 38 nt, Artificial Sequence
  Description of Artificial Sequence:  Enzymatic Nucleic Acid
  misc_feature (31)..(31): n stands for inosine
cacucccacugaugaggccguuaggccgaangcacagc

SEQ ID NO: 5722 - RNA, 38 nt, Artificial Sequence
  Description of Artificial Sequence:  Enzymatic Nucleic Acid
  misc_feature (31)..(31): n stands for inosine
gcacuccccugaugaggccguuaggccgaanggcacag

SEQ ID NO: 5723 - RNA, 38 nt, Artificial Sequence
  Description of Artificial Sequence:  Enzymatic Nucleic Acid
  misc_feature (31)..(31): n stands for inosine
aagagggccugaugaggccguuaggccgaancacuccc

SEQ ID NO: 5724 - RNA, 38 nt, Artificial Sequence
  Description of Artificial Sequence:  Enzymatic Nucleic Acid
  misc_feature (31)..(31): n stands for inosine
gguaagagcugaugaggccguuaggccgaancagcacu

SEQ ID NO: 5725 - RNA, 38 nt, Artificial Sequence
  Description of Artificial Sequence:  Enzymatic Nucleic Acid
  misc_feature (31)..(31): n stands for inosine
ugguaagacugaugaggccguuaggccgaangcagcac

SEQ ID NO: 5726 - RNA, 38 nt, Artificial Sequence
  Description of Artificial Sequence:  Enzymatic Nucleic Acid
  misc_feature (31)..(31): n stands for inosine
augguaagcugaugaggccguuaggccgaanggcagca

SEQ ID NO: 5727 - RNA, 38 nt, Artificial Sequence
  Description of Artificial Sequence:  Enzymatic Nucleic Acid
  misc_feature (31)..(31): n stands for inosine
gcaugguacugaugaggccguuaggccgaanagggcag

SEQ ID NO: 5728 - RNA, 38 nt, Artificial Sequence
  Description of Artificial Sequence:  Enzymatic Nucleic Acid
  misc_feature (31)..(31): n stands for inosine
gugugcaucugaugaggccguuaggccgaanuaagagg

SEQ ID NO: 5729 - RNA, 38 nt, Artificial Sequence
  Description of Artificial Sequence:  Enzymatic Nucleic Acid
  misc_feature (31)..(31): n stands for inosine
cgugugcacugaugaggccguuaggccgaanguaagag

SEQ ID NO: 5730 - RNA, 38 nt, Artificial Sequence
  Description of Artificial Sequence:  Enzymatic Nucleic Acid
  misc_feature (31)..(31): n stands for inosine
cacccgugcugaugaggccguuaggccgaancauggua

SEQ ID NO: 5731 - RNA, 38 nt, Artificial Sequence
  Description of Artificial Sequence:  Enzymatic Nucleic Acid
  misc_feature (31)..(31): n stands for inosine
agcacccgcugaugaggccguuaggccgaanugcaugg

SEQ ID NO: 5732 - RNA, 38 nt, Artificial Sequence
  Description of Artificial Sequence:  Enzymatic Nucleic Acid
  misc_feature (31)..(31): n stands for inosine
aaaaggagcugaugaggccguuaggccgaancacccgu

SEQ ID NO: 5733 - RNA, 38 nt, Artificial Sequence
  Description of Artificial Sequence:  Enzymatic Nucleic Acid
  misc_feature (31)..(31): n stands for inosine
ccaaaaggcugaugaggccguuaggccgaanagcaccc

SEQ ID NO: 5734 - RNA, 38 nt, Artificial Sequence
  Description of Artificial Sequence:  Enzymatic Nucleic Acid
  misc_feature (31)..(31): n stands for inosine
gcccaaaacugaugaggccguuaggccgaanagagcac

SEQ ID NO: 5735 - RNA, 38 nt, Artificial Sequence
  Description of Artificial Sequence:  Enzymatic Nucleic Acid
  misc_feature (31)..(31): n stands for inosine
agcccaaacugaugaggccguuaggccgaangagagca

SEQ ID NO: 5736 - RNA, 38 nt, Artificial Sequence
  Description of Artificial Sequence:  Enzymatic Nucleic Acid
  misc_feature (31)..(31): n stands for inosine
uagcaugccugaugaggccguuaggccgaancccaaaa

SEQ ID NO: 5737 - RNA, 38 nt, Artificial Sequence
  Description of Artificial Sequence:  Enzymatic Nucleic Acid
  misc_feature (31)..(31): n stands for inosine
gaauagcacugaugaggccguuaggccgaancagccca

SEQ ID NO: 5738 - RNA, 38 nt, Artificial Sequence
  Description of Artificial Sequence:  Enzymatic Nucleic Acid
  misc_feature (31)..(31): n stands for inosine
aauggaaucugaugaggccguuaggccgaancaugcag

SEQ ID NO: 5739 - RNA, 38 nt, Artificial Sequence
  Description of Artificial Sequence:  Enzymatic Nucleic Acid
  misc_feature (31)..(31): n stands for inosine
ugcaaaaucugaugaggccguuaggccgaanaauagca

SEQ ID NO: 5740 - RNA, 38 nt, Artificial Sequence
  Description of Artificial Sequence:  Enzymatic Nucleic Acid
  misc_feature (31)..(31): n stands for inosine
cugcaaaacugaugaggccguuaggccgaangaauagc

SEQ ID NO: 5741 - RNA, 38 nt, Artificial Sequence
  Description of Artificial Sequence:  Enzymatic Nucleic Acid
  misc_feature (31)..(31): n stands for inosine
ggucuggccugaugaggccguuaggccgaancaaaaug

SEQ ID NO: 5742 - RNA, 38 nt, Artificial Sequence
  Description of Artificial Sequence:  Enzymatic Nucleic Acid
  misc_feature (31)..(31): n stands for inosine
aucggucucugaugaggccguuaggccgaancugcaaa

SEQ ID NO: 5743 - RNA, 38 nt, Artificial Sequence
  Description of Artificial Sequence:  Enzymatic Nucleic Acid
  misc_feature (31)..(31): n stands for inosine
caucgguccugaugaggccguuaggccgaangcugcaa

SEQ ID NO: 5744 - RNA, 38 nt, Artificial Sequence
  Description of Artificial Sequence:  Enzymatic Nucleic Acid
  misc_feature (31)..(31): n stands for inosine
uacacauccugaugaggccguuaggccgaanucuggcu

SEQ ID NO: 5745 - RNA, 38 nt, Artificial Sequence
  Description of Artificial Sequence:  Enzymatic Nucleic Acid
  misc_feature (31)..(31): n stands for inosine
uagugacucugaugaggccguuaggccgaanuuaaaua

SEQ ID NO: 5746 - RNA, 38 nt, Artificial Sequence
  Description of Artificial Sequence:  Enzymatic Nucleic Acid
  misc_feature (31)..(31): n stands for inosine
auagugaccugaugaggccguuaggccgaanguuaaau

SEQ ID NO: 5747 - RNA, 38 nt, Artificial Sequence
  Description of Artificial Sequence:  Enzymatic Nucleic Acid
  misc_feature (31)..(31): n stands for inosine
aucaauagcugaugaggccguuaggccgaanacugguu

SEQ ID NO: 5748 - RNA, 38 nt, Artificial Sequence
  Description of Artificial Sequence:  Enzymatic Nucleic Acid
  misc_feature (31)..(31): n stands for inosine
ccaucaaucugaugaggccguuaggccgaanugacugg

SEQ ID NO: 5749 - RNA, 38 nt, Artificial Sequence
  Description of Artificial Sequence:  Enzymatic Nucleic Acid
  misc_feature (31)..(31): n stands for inosine
aacccaaacugaugaggccguuaggccgaanuccauca

SEQ ID NO: 5750 - RNA, 38 nt, Artificial Sequence
  Description of Artificial Sequence:  Enzymatic Nucleic Acid
  misc_feature (31)..(31): n stands for inosine
aaaagaugcugaugaggccguuaggccgaanaaacaac

SEQ ID NO: 5751 - RNA, 38 nt, Artificial Sequence
  Description of Artificial Sequence:  Enzymatic Nucleic Acid
  misc_feature (31)..(31): n stands for inosine
aaaaagaucugaugaggccguuaggccgaangaaacaa

SEQ ID NO: 5752 - RNA, 38 nt, Artificial Sequence
  Description of Artificial Sequence:  Enzymatic Nucleic Acid
  misc_feature (31)..(31): n stands for inosine
caaaaagacugaugaggccguuaggccgaanggaaaca

SEQ ID NO: 5753 - RNA, 38 nt, Artificial Sequence
  Description of Artificial Sequence:  Enzymatic Nucleic Acid
  misc_feature (31)..(31): n stands for inosine
uaacaaaacugaugaggccguuaggccgaanaugggaa

SEQ ID NO: 5754 - RNA, 38 nt, Artificial Sequence
  Description of Artificial Sequence:  Enzymatic Nucleic Acid
  misc_feature (31)..(31): n stands for inosine
uuauuuaucugaugaggccguuaggccgaanuaacaaa

SEQ ID NO: 5755 - RNA, 38 nt, Artificial Sequence
  Description of Artificial Sequence:  Enzymatic Nucleic Acid
  misc_feature (31)..(31): n stands for inosine
auuauuuacugaugaggccguuaggccgaanguaacaa

SEQ ID NO: 5756 - RNA, 38 nt, Artificial Sequence
  Description of Artificial Sequence:  Enzymatic Nucleic Acid
  misc_feature (31)..(31): n stands for inosine
uuuuacuacugaugaggccguuaggccgaanccauuau

SEQ ID NO: 5757 - RNA, 17 nt, Homo sapiens
cgagcauggcccuugug

SEQ ID NO: 5758 - RNA, 17 nt, Homo sapiens
uggcccuugugauccag

SEQ ID NO: 5759 - RNA, 17 nt, Homo sapiens
ugauccagguggggaaa

SEQ ID NO: 5760 - RNA, 17 nt, Homo sapiens
aaacuaaggcccagaga

SEQ ID NO: 5761 - RNA, 17 nt, Homo sapiens
ccagagaagugaggacc

SEQ ID NO: 5762 - RNA, 17 nt, Homo sapiens
aggaccccgcagacuau

SEQ ID NO: 5763 - RNA, 17 nt, Homo sapiens
caaucccagucucuucc

SEQ ID NO: 5764 - RNA, 17 nt, Homo sapiens
cacucccugugaagcuc

SEQ ID NO: 5765 - RNA, 17 nt, Homo sapiens
ccugugaagcucuccag

SEQ ID NO: 5766 - RNA, 17 nt, Homo sapiens
gcucuccagcaucaucg

SEQ ID NO: 5767 - RNA, 17 nt, Homo sapiens
ucaucgaggucccauca

SEQ ID NO: 5768 - RNA, 17 nt, Homo sapiens
ucccaucagcccuugcc

SEQ ID NO: 5769 - RNA, 17 nt, Homo sapiens
cagcccuugcccuguug

SEQ ID NO: 5770 - RNA, 17 nt, Homo sapiens
cuugcccuguuggauga

SEQ ID NO: 5771 - RNA, 17 nt, Homo sapiens
augaauaggcaccucug

SEQ ID NO: 5772 - RNA, 17 nt, Homo sapiens
cuggaagagccaacugu

SEQ ID NO: 5773 - RNA, 17 nt, Homo sapiens
agccaacugugugagau

SEQ ID NO: 5774 - RNA, 17 nt, Homo sapiens
ccaacugugugagaugg

SEQ ID NO: 5775 - RNA, 17 nt, Homo sapiens
gugagauggugcagccc

SEQ ID NO: 5776 - RNA, 17 nt, Homo sapiens
gagauggugcagcccag

SEQ ID NO: 5777 - RNA, 17 nt, Homo sapiens
auggugcagcccagugg

SEQ ID NO: 5778 - RNA, 17 nt, Homo sapiens
gcagcccagugguggcc

SEQ ID NO: 5779 - RNA, 17 nt, Homo sapiens
gcccagugguggcccgg

SEQ ID NO: 5780 - RNA, 17 nt, Homo sapiens
cagugguggcccggcag

SEQ ID NO: 5781 - RNA, 17 nt, Homo sapiens
guggcccggcagcagau

SEQ ID NO: 5782 - RNA, 17 nt, Homo sapiens
gcccggcagcagaucag

SEQ ID NO: 5783 - RNA, 17 nt, Homo sapiens
aucaggacguacugggc

SEQ ID NO: 5784 - RNA, 17 nt, Homo sapiens
cguacugggcgaagagu

SEQ ID NO: 5785 - RNA, 17 nt, Homo sapiens
ggcgaagagucuccucu

SEQ ID NO: 5786 - RNA, 17 nt, Homo sapiens
cuggggaagccagccau

SEQ ID NO: 5787 - RNA, 17 nt, Homo sapiens
ggaagccagccaugcug

SEQ ID NO: 5788 - RNA, 17 nt, Homo sapiens
ccagccaugcugcaccu

SEQ ID NO: 5789 - RNA, 17 nt, Homo sapiens
gccaugcugcaccugcc

SEQ ID NO: 5790 - RNA, 17 nt, Homo sapiens
cugcaccugccuucaga

SEQ ID NO: 5791 - RNA, 17 nt, Homo sapiens
agaacagggcgcuccug

SEQ ID NO: 5792 - RNA, 17 nt, Homo sapiens
aacagggcgcuccugag

SEQ ID NO: 5793 - RNA, 17 nt, Homo sapiens
acccuccagcgcugccu

SEQ ID NO: 5794 - RNA, 17 nt, Homo sapiens
ccuccagcgcugccugg

SEQ ID NO: 5795 - RNA, 17 nt, Homo sapiens
ccagcgcugccuggagg

SEQ ID NO: 5796 - RNA, 17 nt, Homo sapiens
aaucaagagcuccgaga

SEQ ID NO: 5797 - RNA, 17 nt, Homo sapiens
uccgagaugccauccgg

SEQ ID NO: 5798 - RNA, 17 nt, Homo sapiens
gccauccggcagagcaa

SEQ ID NO: 5799 - RNA, 17 nt, Homo sapiens
ccggcagagcaaccaga

SEQ ID NO: 5800 - RNA, 17 nt, Homo sapiens
cagauucugcgggagcg

SEQ ID NO: 5801 - RNA, 17 nt, Homo sapiens
cugcgggagcgcugcga

SEQ ID NO: 5802 - RNA, 17 nt, Homo sapiens
gcgggagcgcugcgagg

SEQ ID NO: 5803 - RNA, 17 nt, Homo sapiens
ggagcgcugcgaggagc

SEQ ID NO: 5804 - RNA, 17 nt, Homo sapiens
ugcgaggagcuucugca

SEQ ID NO: 5805 - RNA, 17 nt, Homo sapiens
gagcuucugcauuucca

SEQ ID NO: 5806 - RNA, 17 nt, Homo sapiens
auuuccaagccagccag

SEQ ID NO: 5807 - RNA, 17 nt, Homo sapiens
ccaagccagccagaggg

SEQ ID NO: 5808 - RNA, 17 nt, Homo sapiens
gagaaggaguuccucau

SEQ ID NO: 5809 - RNA, 17 nt, Homo sapiens
uuccucaugugcaaguu

SEQ ID NO: 5810 - RNA, 17 nt, Homo sapiens
ccucaugugcaaguucc

SEQ ID NO: 5811 - RNA, 17 nt, Homo sapiens
augugcaaguuccagga

SEQ ID NO: 5812 - RNA, 17 nt, Homo sapiens
uccaggaggccaggaaa

SEQ ID NO: 5813 - RNA, 17 nt, Homo sapiens
ggaaacugguggagaga

SEQ ID NO: 5814 - RNA, 17 nt, Homo sapiens
gagacucggccuggaga

SEQ ID NO: 5815 - RNA, 17 nt, Homo sapiens
cuggagaagcucgaucu

SEQ ID NO: 5816 - RNA, 17 nt, Homo sapiens
cugaagaggcagaagga

SEQ ID NO: 5817 - RNA, 17 nt, Homo sapiens
cagaaggagcaggcucu

SEQ ID NO: 5818 - RNA, 17 nt, Homo sapiens
aggagcaggcucugcgg

SEQ ID NO: 5819 - RNA, 17 nt, Homo sapiens
caggcucugcgggaggu

SEQ ID NO: 5820 - RNA, 17 nt, Homo sapiens
ugcgggagguggagcac

SEQ ID NO: 5821 - RNA, 17 nt, Homo sapiens
gagguggagcaccugaa

SEQ ID NO: 5822 - RNA, 17 nt, Homo sapiens
gaagagaugccagcagc

SEQ ID NO: 5823 - RNA, 17 nt, Homo sapiens
agaugccagcagcagau

SEQ ID NO: 5824 - RNA, 17 nt, Homo sapiens
ugccagcagcagauggc

SEQ ID NO: 5825 - RNA, 17 nt, Homo sapiens
agcagauggcugaggac

SEQ ID NO: 5826 - RNA, 17 nt, Homo sapiens
aggacaaggccucugug

SEQ ID NO: 5827 - RNA, 17 nt, Homo sapiens
aggccucugugaaagcc

SEQ ID NO: 5828 - RNA, 17 nt, Homo sapiens
cugugaaagcccaggug

SEQ ID NO: 5829 - RNA, 17 nt, Homo sapiens
aagcccaggugacgucc

SEQ ID NO: 5830 - RNA, 17 nt, Homo sapiens
caggugacguccuugcu

SEQ ID NO: 5831 - RNA, 17 nt, Homo sapiens
acguccuugcucgggga

SEQ ID NO: 5832 - RNA, 17 nt, Homo sapiens
cucggggagcugcagga

SEQ ID NO: 5833 - RNA, 17 nt, Homo sapiens
ggggagcugcaggagag

SEQ ID NO: 5834 - RNA, 17 nt, Homo sapiens
gcaggagagccagaguc

SEQ ID NO: 5835 - RNA, 17 nt, Homo sapiens
gagccagagucgcuugg

SEQ ID NO: 5836 - RNA, 17 nt, Homo sapiens
ccagagucgcuuggagg

SEQ ID NO: 5837 - RNA, 17 nt, Homo sapiens
gcuuggaggcugccacu

SEQ ID NO: 5838 - RNA, 17 nt, Homo sapiens
uggaggcugccacuaag

SEQ ID NO: 5839 - RNA, 17 nt, Homo sapiens
uaaggaaugccaggcuc

SEQ ID NO: 5840 - RNA, 17 nt, Homo sapiens
aaugccaggcucuggag

SEQ ID NO: 5841 - RNA, 17 nt, Homo sapiens
ucuggagggucgggccc

SEQ ID NO: 5842 - RNA, 17 nt, Homo sapiens
agggucgggcccgggcg

SEQ ID NO: 5843 - RNA, 17 nt, Homo sapiens
gggcccgggcggccagc

SEQ ID NO: 5844 - RNA, 17 nt, Homo sapiens
cccgggcggccagcgag

SEQ ID NO: 5845 - RNA, 17 nt, Homo sapiens
ggcggccagcgagcagg

SEQ ID NO: 5846 - RNA, 17 nt, Homo sapiens
gccagcgagcaggcgcg

SEQ ID NO: 5847 - RNA, 17 nt, Homo sapiens
gcgagcaggcgcggcag

SEQ ID NO: 5848 - RNA, 17 nt, Homo sapiens
gagcaggcgcggcagcu

SEQ ID NO: 5849 - RNA, 17 nt, Homo sapiens
caggcgcggcagcugga

SEQ ID NO: 5850 - RNA, 17 nt, Homo sapiens
gcgcggcagcuggagag

SEQ ID NO: 5851 - RNA, 17 nt, Homo sapiens
gcuggagagugagcgcg

SEQ ID NO: 5852 - RNA, 17 nt, Homo sapiens
gagagugagcgcgaggc

SEQ ID NO: 5853 - RNA, 17 nt, Homo sapiens
gagugagcgcgaggcgc

SEQ ID NO: 5854 - RNA, 17 nt, Homo sapiens
agcgcgaggcgcugcag

SEQ ID NO: 5855 - RNA, 17 nt, Homo sapiens
cgcgaggcgcugcagca

SEQ ID NO: 5856 - RNA, 17 nt, Homo sapiens
gaggcgcugcagcagca

SEQ ID NO: 5857 - RNA, 17 nt, Homo sapiens
gcgcugcagcagcagca

SEQ ID NO: 5858 - RNA, 17 nt, Homo sapiens
cugcagcagcagcacag

SEQ ID NO: 5859 - RNA, 17 nt, Homo sapiens
cagcagcagcacagcgu

SEQ ID NO: 5860 - RNA, 17 nt, Homo sapiens
gcagcacagcgugcagg

SEQ ID NO: 5861 - RNA, 17 nt, Homo sapiens
agcacagcgugcaggug

SEQ ID NO: 5862 - RNA, 17 nt, Homo sapiens
cacagcgugcaggugga

SEQ ID NO: 5863 - RNA, 17 nt, Homo sapiens
gcgugcagguggaccag

SEQ ID NO: 5864 - RNA, 17 nt, Homo sapiens
guggaccagcugcgcau

SEQ ID NO: 5865 - RNA, 17 nt, Homo sapiens
gaccagcugcgcaugca

SEQ ID NO: 5866 - RNA, 17 nt, Homo sapiens
ccagcugcgcaugcagg

SEQ ID NO: 5867 - RNA, 17 nt, Homo sapiens
cugcgcaugcagggcca

SEQ ID NO: 5868 - RNA, 17 nt, Homo sapiens
caugcagggccagagcg

SEQ ID NO: 5869 - RNA, 17 nt, Homo sapiens
gggccagagcguggagg

SEQ ID NO: 5870 - RNA, 17 nt, Homo sapiens
gccagagcguggaggcc

SEQ ID NO: 5871 - RNA, 17 nt, Homo sapiens
gcguggaggccgcgcuc

SEQ ID NO: 5872 - RNA, 17 nt, Homo sapiens
uggaggccgcgcuccgc

SEQ ID NO: 5873 - RNA, 17 nt, Homo sapiens
gaggccgcgcuccgcau

SEQ ID NO: 5874 - RNA, 17 nt, Homo sapiens
cgcgcuccgcauggagc

SEQ ID NO: 5875 - RNA, 17 nt, Homo sapiens
cgcauggagcgccaggc

SEQ ID NO: 5876 - RNA, 17 nt, Homo sapiens
cauggagcgccaggccg

SEQ ID NO: 5877 - RNA, 17 nt, Homo sapiens
agcgccaggccgccucg

SEQ ID NO: 5878 - RNA, 17 nt, Homo sapiens
gccaggccgccucggag

SEQ ID NO: 5879 - RNA, 17 nt, Homo sapiens
aagaggaagcuggccca

SEQ ID NO: 5880 - RNA, 17 nt, Homo sapiens
ggaagcuggcccaguug

SEQ ID NO: 5881 - RNA, 17 nt, Homo sapiens
cuggcccaguugcaggu

SEQ ID NO: 5882 - RNA, 17 nt, Homo sapiens
gcccaguugcagguggc

SEQ ID NO: 5883 - RNA, 17 nt, Homo sapiens
aguugcagguggccuau

SEQ ID NO: 5884 - RNA, 17 nt, Homo sapiens
ugcagguggccuaucac

SEQ ID NO: 5885 - RNA, 17 nt, Homo sapiens
uaucaccagcucuucca

SEQ ID NO: 5886 - RNA, 17 nt, Homo sapiens
caucaagagcagcgugg

SEQ ID NO: 5887 - RNA, 17 nt, Homo sapiens
caagagcagcguggugg

SEQ ID NO: 5888 - RNA, 17 nt, Homo sapiens
agagcagcguggugggc

SEQ ID NO: 5889 - RNA, 17 nt, Homo sapiens
gcagcguggugggcagu

SEQ ID NO: 5890 - RNA, 17 nt, Homo sapiens
cguggugggcagugagc

SEQ ID NO: 5891 - RNA, 17 nt, Homo sapiens
ggugggcagugagcgga

SEQ ID NO: 5892 - RNA, 17 nt, Homo sapiens
ggcagugagcggaagcg

SEQ ID NO: 5893 - RNA, 17 nt, Homo sapiens
gagcggaagcgaggaau

SEQ ID NO: 5894 - RNA, 17 nt, Homo sapiens
cgaggaaugcagcugga

SEQ ID NO: 5895 - RNA, 17 nt, Homo sapiens
ggaaugcagcuggaaga

SEQ ID NO: 5896 - RNA, 17 nt, Homo sapiens
cucaaacagcagcucca

SEQ ID NO: 5897 - RNA, 17 nt, Homo sapiens
aaacagcagcuccagca

SEQ ID NO: 5898 - RNA, 17 nt, Homo sapiens
cagcuccagcaggccga

SEQ ID NO: 5899 - RNA, 17 nt, Homo sapiens
uccagcaggccgaggag

SEQ ID NO: 5900 - RNA, 17 nt, Homo sapiens
ccgaggaggcccuggug

SEQ ID NO: 5901 - RNA, 17 nt, Homo sapiens
aggcccugguggccaaa

SEQ ID NO: 5902 - RNA, 17 nt, Homo sapiens
cccugguggccaaacag

SEQ ID NO: 5903 - RNA, 17 nt, Homo sapiens
aacaggaggugaucgau

SEQ ID NO: 5904 - RNA, 17 nt, Homo sapiens
aucgauaagcugaagga

SEQ ID NO: 5905 - RNA, 17 nt, Homo sapiens
aggaggaggccgagcag

SEQ ID NO: 5906 - RNA, 17 nt, Homo sapiens
gaggccgagcagcacaa

SEQ ID NO: 5907 - RNA, 17 nt, Homo sapiens
gccgagcagcacaagau

SEQ ID NO: 5908 - RNA, 17 nt, Homo sapiens
acaagauugugauggag

SEQ ID NO: 5909 - RNA, 17 nt, Homo sapiens
uggagaccguuccggug

SEQ ID NO: 5910 - RNA, 17 nt, Homo sapiens
ccguuccggugcugaag

SEQ ID NO: 5911 - RNA, 17 nt, Homo sapiens
guuccggugcugaaggc

SEQ ID NO: 5912 - RNA, 17 nt, Homo sapiens
ugcugaaggcccaggcg

SEQ ID NO: 5913 - RNA, 17 nt, Homo sapiens
aggcccaggcggauauc

SEQ ID NO: 5914 - RNA, 17 nt, Homo sapiens
ucuacaaggcggacuuc

SEQ ID NO: 5915 - RNA, 17 nt, Homo sapiens
acuuccaggcugagagg

SEQ ID NO: 5916 - RNA, 17 nt, Homo sapiens
gcugagaggcaggcccg

SEQ ID NO: 5917 - RNA, 17 nt, Homo sapiens
agaggcaggcccgggag

SEQ ID NO: 5918 - RNA, 17 nt, Homo sapiens
cgggagaagcuggccga

SEQ ID NO: 5919 - RNA, 17 nt, Homo sapiens
agaagcuggccgagaag

SEQ ID NO: 5920 - RNA, 17 nt, Homo sapiens
aagaaggagcuccugca

SEQ ID NO: 5921 - RNA, 17 nt, Homo sapiens
gagcuccugcaggagca

SEQ ID NO: 5922 - RNA, 17 nt, Homo sapiens
cugcaggagcagcugga

SEQ ID NO: 5923 - RNA, 17 nt, Homo sapiens
caggagcagcuggagca

SEQ ID NO: 5924 - RNA, 17 nt, Homo sapiens
cagcuggagcagcugca

SEQ ID NO: 5925 - RNA, 17 nt, Homo sapiens
cuggagcagcugcagag

SEQ ID NO: 5926 - RNA, 17 nt, Homo sapiens
gagcagcugcagaggga

SEQ ID NO: 5927 - RNA, 17 nt, Homo sapiens
cagagggaguacagcaa

SEQ ID NO: 5928 - RNA, 17 nt, Homo sapiens
ggaguacagcaaacuga

SEQ ID NO: 5929 - RNA, 17 nt, Homo sapiens
aacugaaggccagcugu

SEQ ID NO: 5930 - RNA, 17 nt, Homo sapiens
gaaggccagcugucagg

SEQ ID NO: 5931 - RNA, 17 nt, Homo sapiens
ggccagcugucaggagu

SEQ ID NO: 5932 - RNA, 17 nt, Homo sapiens
ugucaggagucggccag

SEQ ID NO: 5933 - RNA, 17 nt, Homo sapiens
aggagucggccaggauc

SEQ ID NO: 5934 - RNA, 17 nt, Homo sapiens
augaggaagcggcaugu

SEQ ID NO: 5935 - RNA, 17 nt, Homo sapiens
aggaagcggcaugucga

SEQ ID NO: 5936 - RNA, 17 nt, Homo sapiens
agcggcaugucgagguc

SEQ ID NO: 5937 - RNA, 17 nt, Homo sapiens
augucgaggucucccag

SEQ ID NO: 5938 - RNA, 17 nt, Homo sapiens
ucucccaggcccccuug

SEQ ID NO: 5939 - RNA, 17 nt, Homo sapiens
gcccccuugccccccgc

SEQ ID NO: 5940 - RNA, 17 nt, Homo sapiens
ugccccccgccccugcc

SEQ ID NO: 5941 - RNA, 17 nt, Homo sapiens
ccgccccugccuaccuc

SEQ ID NO: 5942 - RNA, 17 nt, Homo sapiens
cuccccuggcccugccc

SEQ ID NO: 5943 - RNA, 17 nt, Homo sapiens
cuggcccugcccagcca

SEQ ID NO: 5944 - RNA, 17 nt, Homo sapiens
ccugcccagccagagga

SEQ ID NO: 5945 - RNA, 17 nt, Homo sapiens
gaggaggagcccccccg

SEQ ID NO: 5946 - RNA, 17 nt, Homo sapiens
cccgaggagccaccuga

SEQ ID NO: 5947 - RNA, 17 nt, Homo sapiens
ugacuucugcuguccca

SEQ ID NO: 5948 - RNA, 17 nt, Homo sapiens
cuucugcugucccaagu

SEQ ID NO: 5949 - RNA, 17 nt, Homo sapiens
ugucccaagugccagua

SEQ ID NO: 5950 - RNA, 17 nt, Homo sapiens
ucccaagugccaguauc

SEQ ID NO: 5951 - RNA, 17 nt, Homo sapiens
aagugccaguaucaggc

SEQ ID NO: 5952 - RNA, 17 nt, Homo sapiens
aguaucaggccccugau

SEQ ID NO: 5953 - RNA, 17 nt, Homo sapiens
gacacccugcagauaca

SEQ ID NO: 5954 - RNA, 17 nt, Homo sapiens
agauacaugucauggag

SEQ ID NO: 5955 - RNA, 17 nt, Homo sapiens
gucauggagugcauuga

SEQ ID NO: 5956 - RNA, 17 nt, Homo sapiens
cauggagugcauugagu

SEQ ID NO: 5957 - RNA, 17 nt, Homo sapiens
ugcauugaguagggccg

SEQ ID NO: 5958 - RNA, 17 nt, Homo sapiens
ugaguagggccggccag

SEQ ID NO: 5959 - RNA, 17 nt, Homo sapiens
uagggccggccagugca

SEQ ID NO: 5960 - RNA, 17 nt, Homo sapiens
gccggccagugcaaggc

SEQ ID NO: 5961 - RNA, 17 nt, Homo sapiens
cggccagugcaaggcca

SEQ ID NO: 5962 - RNA, 17 nt, Homo sapiens
agugcaaggccacugcc

SEQ ID NO: 5963 - RNA, 17 nt, Homo sapiens
aggccacugccugcccg

SEQ ID NO: 5964 - RNA, 17 nt, Homo sapiens
cacugccugcccgagga

SEQ ID NO: 5965 - RNA, 17 nt, Homo sapiens
ccgaggacgugcccggg

SEQ ID NO: 5966 - RNA, 17 nt, Homo sapiens
gaggacgugcccgggac

SEQ ID NO: 5967 - RNA, 17 nt, Homo sapiens
ccgggaccgugcagucu

SEQ ID NO: 5968 - RNA, 17 nt, Homo sapiens
gggaccgugcagucugc

SEQ ID NO: 5969 - RNA, 17 nt, Homo sapiens
accgugcagucugcgcu

SEQ ID NO: 5970 - RNA, 17 nt, Homo sapiens
ugcagucugcgcuuucc

SEQ ID NO: 5971 - RNA, 17 nt, Homo sapiens
cagucugcgcuuuccuc

SEQ ID NO: 5972 - RNA, 17 nt, Homo sapiens
ccucucccgccugccua

SEQ ID NO: 5973 - RNA, 17 nt, Homo sapiens
ucccgccugccuagccc

SEQ ID NO: 5974 - RNA, 17 nt, Homo sapiens
ccugccuagcccaggau

SEQ ID NO: 5975 - RNA, 17 nt, Homo sapiens
gaugaagggcugggugg

SEQ ID NO: 5976 - RNA, 17 nt, Homo sapiens
agggcuggguggccaca

SEQ ID NO: 5977 - RNA, 17 nt, Homo sapiens
gcuggguggccacaacu

SEQ ID NO: 5978 - RNA, 17 nt, Homo sapiens
acugggaugccaccugg

SEQ ID NO: 5979 - RNA, 17 nt, Homo sapiens
caccuggagccccaccc

SEQ ID NO: 5980 - RNA, 17 nt, Homo sapiens
acccaggagcuggccgc

SEQ ID NO: 5981 - RNA, 17 nt, Homo sapiens
aggagcuggccgcggca

SEQ ID NO: 5982 - RNA, 17 nt, Homo sapiens
agcuggccgcggcaccu

SEQ ID NO: 5983 - RNA, 17 nt, Homo sapiens
uggccgcggcaccuuac

SEQ ID NO: 5984 - RNA, 17 nt, Homo sapiens
caccuuacgcuucagcu

SEQ ID NO: 5985 - RNA, 17 nt, Homo sapiens
acgcuucagcuguugau

SEQ ID NO: 5986 - RNA, 17 nt, Homo sapiens
cuucagcuguugauccg

SEQ ID NO: 5987 - RNA, 17 nt, Homo sapiens
guugauccgcugguccc

SEQ ID NO: 5988 - RNA, 17 nt, Homo sapiens
auccgcugguccccucu

SEQ ID NO: 5989 - RNA, 17 nt, Homo sapiens
cuuuugggguagaugcg

SEQ ID NO: 5990 - RNA, 17 nt, Homo sapiens
ggguagaugcggccccg

SEQ ID NO: 5991 - RNA, 17 nt, Homo sapiens
uagaugcggccccgauc

SEQ ID NO: 5992 - RNA, 17 nt, Homo sapiens
ccgaucaggccugacuc

SEQ ID NO: 5993 - RNA, 17 nt, Homo sapiens
ccugacucgcugcucuu

SEQ ID NO: 5994 - RNA, 17 nt, Homo sapiens
gacucgcugcucuuuuu

SEQ ID NO: 5995 - RNA, 17 nt, Homo sapiens
cucuuuuuguucccuuc

SEQ ID NO: 5996 - RNA, 17 nt, Homo sapiens
ucccuucugucugcucg

SEQ ID NO: 5997 - RNA, 17 nt, Homo sapiens
uucugucugcucgaacc

SEQ ID NO: 5998 - RNA, 17 nt, Homo sapiens
aaccacuugccucgggc

SEQ ID NO: 5999 - RNA, 17 nt, Homo sapiens
ugccucgggcuaauccc

SEQ ID NO: 6000 - RNA, 17 nt, Homo sapiens
uccacccggcacugggg

SEQ ID NO: 6001 - RNA, 17 nt, Homo sapiens
cuggggaagucaagaau

SEQ ID NO: 6002 - RNA, 17 nt, Homo sapiens
agaauggggccuggggc

SEQ ID NO: 6003 - RNA, 17 nt, Homo sapiens
ggccuggggcucucagg

SEQ ID NO: 6004 - RNA, 17 nt, Homo sapiens
ggagaacugcuuccccu

SEQ ID NO: 6005 - RNA, 17 nt, Homo sapiens
uuccccuggcagagcug

SEQ ID NO: 6006 - RNA, 17 nt, Homo sapiens
cuggcagagcugggugg

SEQ ID NO: 6007 - RNA, 17 nt, Homo sapiens
agagcuggguggcagcu

SEQ ID NO: 6008 - RNA, 17 nt, Homo sapiens
gcuggguggcagcucuu

SEQ ID NO: 6009 - RNA, 17 nt, Homo sapiens
ggguggcagcucuuccu

SEQ ID NO: 6010 - RNA, 17 nt, Homo sapiens
accgacccgcccgccgc

SEQ ID NO: 6011 - RNA, 17 nt, Homo sapiens
acccgcccgccgcugug

SEQ ID NO: 6012 - RNA, 17 nt, Homo sapiens
cgcccgccgcugugccc

SEQ ID NO: 6013 - RNA, 17 nt, Homo sapiens
ccgccgcugugcccugg

SEQ ID NO: 6014 - RNA, 17 nt, Homo sapiens
gccgcugugcccuggga

SEQ ID NO: 6015 - RNA, 17 nt, Homo sapiens
cccugggagugcugccc

SEQ ID NO: 6016 - RNA, 17 nt, Homo sapiens
cugggagugcugcccuc

SEQ ID NO: 6017 - RNA, 17 nt, Homo sapiens
ggagugcugcccucuua

SEQ ID NO: 6018 - RNA, 17 nt, Homo sapiens
cuuaccaugcacacggg

SEQ ID NO: 6019 - RNA, 17 nt, Homo sapiens
gcacacgggugcucucc

SEQ ID NO: 6020 - RNA, 17 nt, Homo sapiens
acacgggugcucuccuu

SEQ ID NO: 6021 - RNA, 17 nt, Homo sapiens
ccuuuugggcugcaugc

SEQ ID NO: 6022 - RNA, 17 nt, Homo sapiens
uuugggcugcaugcuau

SEQ ID NO: 6023 - RNA, 17 nt, Homo sapiens
ggcugcaugcuauucca

SEQ ID NO: 6024 - RNA, 17 nt, Homo sapiens
uccauuuugcagccaga

SEQ ID NO: 6025 - RNA, 17 nt, Homo sapiens
auuuugcagccagaccg

SEQ ID NO: 6026 - RNA, 17 nt, Homo sapiens
agaccgauguguauuua

SEQ ID NO: 6027 - RNA, 17 nt, Homo sapiens
accgauguguauuuaac

SEQ ID NO: 6028 - RNA, 17 nt, Homo sapiens
uuuaaccagucacuauu

SEQ ID NO: 6029 - RNA, 17 nt, Homo sapiens
acauuuggguuguuucc

SEQ ID NO: 6030 - RNA, 17 nt, Homo sapiens
uuuggguuguuucccau

SEQ ID NO: 6031 - RNA, 17 nt, Homo sapiens
aucuuuuuguuaccaua

SEQ ID NO: 6032 - RNA, 17 nt, Homo sapiens
aaauaauggcauaguaa

SEQ ID NO: 6033 - RNA, 17 nt, Homo sapiens
auggcauaguaaaaaaa

SEQ ID NO: 6034 - RNA, 37 nt, Artificial Sequence
  Description of Artificial Sequence:  Enzymatic Nucleic Acid
cacaaggggccgaaaggcgagugaggucucaugcucg

SEQ ID NO: 6035 - RNA, 37 nt, Artificial Sequence
  Description of Artificial Sequence:  Enzymatic Nucleic Acid
cuggaucagccgaaaggcgagugaggucuaagggcca

SEQ ID NO: 6036 - RNA, 37 nt, Artificial Sequence
  Description of Artificial Sequence:  Enzymatic Nucleic Acid
uuuccccagccgaaaggcgagugaggucucuggauca

SEQ ID NO: 6037 - RNA, 37 nt, Artificial Sequence
  Description of Artificial Sequence:  Enzymatic Nucleic Acid
ucucuggggccgaaaggcgagugaggucucuuaguuu

SEQ ID NO: 6038 - RNA, 37 nt, Artificial Sequence
  Description of Artificial Sequence:  Enzymatic Nucleic Acid
gguccucagccgaaaggcgagugaggucuuucucugg

SEQ ID NO: 6039 - RNA, 37 nt, Artificial Sequence
  Description of Artificial Sequence:  Enzymatic Nucleic Acid
auagucuggccgaaaggcgagugaggucugggguccu

SEQ ID NO: 6040 - RNA, 37 nt, Artificial Sequence
  Description of Artificial Sequence:  Enzymatic Nucleic Acid
ggaagagagccgaaaggcgagugaggucuugggauug

SEQ ID NO: 6041 - RNA, 37 nt, Artificial Sequence
  Description of Artificial Sequence:  Enzymatic Nucleic Acid
gagcuucagccgaaaggcgagugaggucuagggagug

SEQ ID NO: 6042 - RNA, 37 nt, Artificial Sequence
  Description of Artificial Sequence:  Enzymatic Nucleic Acid
cuggagaggccgaaaggcgagugaggucuuucacagg

SEQ ID NO: 6043 - RNA, 37 nt, Artificial Sequence
  Description of Artificial Sequence:  Enzymatic Nucleic Acid
cgaugauggccgaaaggcgagugaggucuuggagagc

SEQ ID NO: 6044 - RNA, 37 nt, Artificial Sequence
  Description of Artificial Sequence:  Enzymatic Nucleic Acid
ugaugggagccgaaaggcgagugaggucucucgauga

SEQ ID NO: 6045 - RNA, 37 nt, Artificial Sequence
  Description of Artificial Sequence:  Enzymatic Nucleic Acid
ggcaaggggccgaaaggcgagugaggucuugauggga

SEQ ID NO: 6046 - RNA, 37 nt, Artificial Sequence
  Description of Artificial Sequence:  Enzymatic Nucleic Acid
caacaggggccgaaaggcgagugaggucuaagggcug

SEQ ID NO: 6047 - RNA, 37 nt, Artificial Sequence
  Description of Artificial Sequence:  Enzymatic Nucleic Acid
ucauccaagccgaaaggcgagugaggucuagggcaag

SEQ ID NO: 6048 - RNA, 37 nt, Artificial Sequence
  Description of Artificial Sequence:  Enzymatic Nucleic Acid
cagagguggccgaaaggcgagugaggucucuauucau

SEQ ID NO: 6049 - RNA, 37 nt, Artificial Sequence
  Description of Artificial Sequence:  Enzymatic Nucleic Acid
acaguugggccgaaaggcgagugaggucuucuuccag

SEQ ID NO: 6050 - RNA, 37 nt, Artificial Sequence
  Description of Artificial Sequence:  Enzymatic Nucleic Acid
aucucacagccgaaaggcgagugaggucuaguuggcu

SEQ ID NO: 6051 - RNA, 37 nt, Artificial Sequence
  Description of Artificial Sequence:  Enzymatic Nucleic Acid
ccaucucagccgaaaggcgagugaggucuacaguugg

SEQ ID NO: 6052 - RNA, 37 nt, Artificial Sequence
  Description of Artificial Sequence:  Enzymatic Nucleic Acid
gggcugcagccgaaaggcgagugaggucucaucucac

SEQ ID NO: 6053 - RNA, 37 nt, Artificial Sequence
  Description of Artificial Sequence:  Enzymatic Nucleic Acid
cugggcuggccgaaaggcgagugaggucuaccaucuc

SEQ ID NO: 6054 - RNA, 37 nt, Artificial Sequence
  Description of Artificial Sequence:  Enzymatic Nucleic Acid
ccacuggggccgaaaggcgagugaggucuugcaccau

SEQ ID NO: 6055 - RNA, 37 nt, Artificial Sequence
  Description of Artificial Sequence:  Enzymatic Nucleic Acid
ggccaccagccgaaaggcgagugaggucuugggcugc

SEQ ID NO: 6056 - RNA, 37 nt, Artificial Sequence
  Description of Artificial Sequence:  Enzymatic Nucleic Acid
ccgggccagccgaaaggcgagugaggucucacugggc

SEQ ID NO: 6057 - RNA, 37 nt, Artificial Sequence
  Description of Artificial Sequence:  Enzymatic Nucleic Acid
cugccggggccgaaaggcgagugaggucucaccacug

SEQ ID NO: 6058 - RNA, 37 nt, Artificial Sequence
  Description of Artificial Sequence:  Enzymatic Nucleic Acid
aucugcuggccgaaaggcgagugaggucucgggccac

SEQ ID NO: 6059 - RNA, 37 nt, Artificial Sequence
  Description of Artificial Sequence:  Enzymatic Nucleic Acid
cugaucuggccgaaaggcgagugaggucuugccgggc

SEQ ID NO: 6060 - RNA, 37 nt, Artificial Sequence
  Description of Artificial Sequence:  Enzymatic Nucleic Acid
gcccaguagccgaaaggcgagugaggucuguccugau

SEQ ID NO: 6061 - RNA, 37 nt, Artificial Sequence
  Description of Artificial Sequence:  Enzymatic Nucleic Acid
acucuucggccgaaaggcgagugaggucuccaguacg

SEQ ID NO: 6062 - RNA, 37 nt, Artificial Sequence
  Description of Artificial Sequence:  Enzymatic Nucleic Acid
agaggagagccgaaaggcgagugaggucuucuucgcc

SEQ ID NO: 6063 - RNA, 37 nt, Artificial Sequence
  Description of Artificial Sequence:  Enzymatic Nucleic Acid
auggcugggccgaaaggcgagugaggucuuuccccag

SEQ ID NO: 6064 - RNA, 37 nt, Artificial Sequence
  Description of Artificial Sequence:  Enzymatic Nucleic Acid
cagcaugggccgaaaggcgagugaggucuuggcuucc

SEQ ID NO: 6065 - RNA, 37 nt, Artificial Sequence
  Description of Artificial Sequence:  Enzymatic Nucleic Acid
aggugcaggccgaaaggcgagugaggucuauggcugg

SEQ ID NO: 6066 - RNA, 37 nt, Artificial Sequence
  Description of Artificial Sequence:  Enzymatic Nucleic Acid
ggcagguggccgaaaggcgagugaggucuagcauggc

SEQ ID NO: 6067 - RNA, 37 nt, Artificial Sequence
  Description of Artificial Sequence:  Enzymatic Nucleic Acid
ucugaagggccgaaaggcgagugaggucuaggugcag

SEQ ID NO: 6068 - RNA, 37 nt, Artificial Sequence
  Description of Artificial Sequence:  Enzymatic Nucleic Acid
caggagcggccgaaaggcgagugaggucuccuguucu

SEQ ID NO: 6069 - RNA, 37 nt, Artificial Sequence
  Description of Artificial Sequence:  Enzymatic Nucleic Acid
cucaggaggccgaaaggcgagugaggucugcccuguu

SEQ ID NO: 6070 - RNA, 37 nt, Artificial Sequence
  Description of Artificial Sequence:  Enzymatic Nucleic Acid
aggcagcggccgaaaggcgagugaggucuuggagggu

SEQ ID NO: 6071 - RNA, 37 nt, Artificial Sequence
  Description of Artificial Sequence:  Enzymatic Nucleic Acid
ccaggcaggccgaaaggcgagugaggucugcuggagg

SEQ ID NO: 6072 - RNA, 37 nt, Artificial Sequence
  Description of Artificial Sequence:  Enzymatic Nucleic Acid
ccuccagggccgaaaggcgagugaggucuagcgcugg

SEQ ID NO: 6073 - RNA, 37 nt, Artificial Sequence
  Description of Artificial Sequence:  Enzymatic Nucleic Acid
ucucggaggccgaaaggcgagugaggucuucuugauu

SEQ ID NO: 6074 - RNA, 37 nt, Artificial Sequence
  Description of Artificial Sequence:  Enzymatic Nucleic Acid
ccggaugggccgaaaggcgagugaggucuaucucgga

SEQ ID NO: 6075 - RNA, 37 nt, Artificial Sequence
  Description of Artificial Sequence:  Enzymatic Nucleic Acid
uugcucuggccgaaaggcgagugaggucucggauggc

SEQ ID NO: 6076 - RNA, 37 nt, Artificial Sequence
  Description of Artificial Sequence:  Enzymatic Nucleic Acid
ucugguuggccgaaaggcgagugaggucuucugccgg

SEQ ID NO: 6077 - RNA, 37 nt, Artificial Sequence
  Description of Artificial Sequence:  Enzymatic Nucleic Acid
cgcucccggccgaaaggcgagugaggucuagaaucug

SEQ ID NO: 6078 - RNA, 37 nt, Artificial Sequence
  Description of Artificial Sequence:  Enzymatic Nucleic Acid
ucgcagcggccgaaaggcgagugaggucuucccgcag

SEQ ID NO: 6079 - RNA, 37 nt, Artificial Sequence
  Description of Artificial Sequence:  Enzymatic Nucleic Acid
ccucgcaggccgaaaggcgagugaggucugcucccgc

SEQ ID NO: 6080 - RNA, 37 nt, Artificial Sequence
  Description of Artificial Sequence:  Enzymatic Nucleic Acid
gcuccucggccgaaaggcgagugaggucuagcgcucc

SEQ ID NO: 6081 - RNA, 37 nt, Artificial Sequence
  Description of Artificial Sequence:  Enzymatic Nucleic Acid
ugcagaaggccgaaaggcgagugaggucuuccucgca

SEQ ID NO: 6082 - RNA, 37 nt, Artificial Sequence
  Description of Artificial Sequence:  Enzymatic Nucleic Acid
uggaaauggccgaaaggcgagugaggucuagaagcuc

SEQ ID NO: 6083 - RNA, 37 nt, Artificial Sequence
  Description of Artificial Sequence:  Enzymatic Nucleic Acid
cuggcugggccgaaaggcgagugaggucuuuggaaau

SEQ ID NO: 6084 - RNA, 37 nt, Artificial Sequence
  Description of Artificial Sequence:  Enzymatic Nucleic Acid
cccucugggccgaaaggcgagugaggucuuggcuugg

SEQ ID NO: 6085 - RNA, 37 nt, Artificial Sequence
  Description of Artificial Sequence:  Enzymatic Nucleic Acid
augaggaagccgaaaggcgagugaggucuuccuucuc

SEQ ID NO: 6086 - RNA, 37 nt, Artificial Sequence
  Description of Artificial Sequence:  Enzymatic Nucleic Acid
aacuugcagccgaaaggcgagugaggucuaugaggaa

SEQ ID NO: 6087 - RNA, 37 nt, Artificial Sequence
  Description of Artificial Sequence:  Enzymatic Nucleic Acid
ggaacuuggccgaaaggcgagugaggucuacaugagg

SEQ ID NO: 6088 - RNA, 37 nt, Artificial Sequence
  Description of Artificial Sequence:  Enzymatic Nucleic Acid
uccuggaagccgaaaggcgagugaggucuuugcacau

SEQ ID NO: 6089 - RNA, 37 nt, Artificial Sequence
  Description of Artificial Sequence:  Enzymatic Nucleic Acid
uuuccugggccgaaaggcgagugaggucucuccugga

SEQ ID NO: 6090 - RNA, 37 nt, Artificial Sequence
  Description of Artificial Sequence:  Enzymatic Nucleic Acid
ucucuccagccgaaaggcgagugaggucucaguuucc

SEQ ID NO: 6091 - RNA, 37 nt, Artificial Sequence
  Description of Artificial Sequence:  Enzymatic Nucleic Acid
ucuccagggccgaaaggcgagugaggucucgagucuc

SEQ ID NO: 6092 - RNA, 37 nt, Artificial Sequence
  Description of Artificial Sequence:  Enzymatic Nucleic Acid
agaucgaggccgaaaggcgagugaggucuuucuccag

SEQ ID NO: 6093 - RNA, 37 nt, Artificial Sequence
  Description of Artificial Sequence:  Enzymatic Nucleic Acid
uccuucuggccgaaaggcgagugaggucucucuucag

SEQ ID NO: 6094 - RNA, 37 nt, Artificial Sequence
  Description of Artificial Sequence:  Enzymatic Nucleic Acid
agagccuggccgaaaggcgagugaggucuuccuucug

SEQ ID NO: 6095 - RNA, 37 nt, Artificial Sequence
  Description of Artificial Sequence:  Enzymatic Nucleic Acid
ccgcagaggccgaaaggcgagugaggucucugcuccu

SEQ ID NO: 6096 - RNA, 37 nt, Artificial Sequence
  Description of Artificial Sequence:  Enzymatic Nucleic Acid
accucccggccgaaaggcgagugaggucuagagccug

SEQ ID NO: 6097 - RNA, 37 nt, Artificial Sequence
  Description of Artificial Sequence:  Enzymatic Nucleic Acid
gugcuccagccgaaaggcgagugaggucucucccgca

SEQ ID NO: 6098 - RNA, 37 nt, Artificial Sequence
  Description of Artificial Sequence:  Enzymatic Nucleic Acid
uucagguggccgaaaggcgagugaggucuuccaccuc

SEQ ID NO: 6099 - RNA, 37 nt, Artificial Sequence
  Description of Artificial Sequence:  Enzymatic Nucleic Acid
gcugcugggccgaaaggcgagugaggucuaucucuuc

SEQ ID NO: 6100 - RNA, 37 nt, Artificial Sequence
  Description of Artificial Sequence:  Enzymatic Nucleic Acid
aucugcuggccgaaaggcgagugaggucuuggcaucu

SEQ ID NO: 6101 - RNA, 37 nt, Artificial Sequence
  Description of Artificial Sequence:  Enzymatic Nucleic Acid
gccaucuggccgaaaggcgagugaggucuugcuggca

SEQ ID NO: 6102 - RNA, 37 nt, Artificial Sequence
  Description of Artificial Sequence:  Enzymatic Nucleic Acid
guccucaggccgaaaggcgagugaggucucaucugcu

SEQ ID NO: 6103 - RNA, 37 nt, Artificial Sequence
  Description of Artificial Sequence:  Enzymatic Nucleic Acid
cacagagggccgaaaggcgagugaggucucuuguccu

SEQ ID NO: 6104 - RNA, 37 nt, Artificial Sequence
  Description of Artificial Sequence:  Enzymatic Nucleic Acid
ggcuuucagccgaaaggcgagugaggucuagaggccu

SEQ ID NO: 6105 - RNA, 37 nt, Artificial Sequence
  Description of Artificial Sequence:  Enzymatic Nucleic Acid
caccuggggccgaaaggcgagugaggucuuuucacag

SEQ ID NO: 6106 - RNA, 37 nt, Artificial Sequence
  Description of Artificial Sequence:  Enzymatic Nucleic Acid
ggacgucagccgaaaggcgagugaggucucugggcuu

SEQ ID NO: 6107 - RNA, 37 nt, Artificial Sequence
  Description of Artificial Sequence:  Enzymatic Nucleic Acid
agcaaggagccgaaaggcgagugaggucugucaccug

SEQ ID NO: 6108 - RNA, 37 nt, Artificial Sequence
  Description of Artificial Sequence:  Enzymatic Nucleic Acid
uccccgaggccgaaaggcgagugaggucuaaggacgu

SEQ ID NO: 6109 - RNA, 37 nt, Artificial Sequence
  Description of Artificial Sequence:  Enzymatic Nucleic Acid
uccugcaggccgaaaggcgagugaggucuuccccgag

SEQ ID NO: 6110 - RNA, 37 nt, Artificial Sequence
  Description of Artificial Sequence:  Enzymatic Nucleic Acid
cucuccuggccgaaaggcgagugaggucuagcucccc

SEQ ID NO: 6111 - RNA, 37 nt, Artificial Sequence
  Description of Artificial Sequence:  Enzymatic Nucleic Acid
gacucugggccgaaaggcgagugaggucuucuccugc

SEQ ID NO: 6112 - RNA, 37 nt, Artificial Sequence
  Description of Artificial Sequence:  Enzymatic Nucleic Acid
ccaagcgagccgaaaggcgagugaggucuucuggcuc

SEQ ID NO: 6113 - RNA, 37 nt, Artificial Sequence
  Description of Artificial Sequence:  Enzymatic Nucleic Acid
ccuccaaggccgaaaggcgagugaggucugacucugg

SEQ ID NO: 6114 - RNA, 37 nt, Artificial Sequence
  Description of Artificial Sequence:  Enzymatic Nucleic Acid
aguggcaggccgaaaggcgagugaggucucuccaagc

SEQ ID NO: 6115 - RNA, 37 nt, Artificial Sequence
  Description of Artificial Sequence:  Enzymatic Nucleic Acid
cuuagugggccgaaaggcgagugaggucuagccucca

SEQ ID NO: 6116 - RNA, 37 nt, Artificial Sequence
  Description of Artificial Sequence:  Enzymatic Nucleic Acid
gagccugggccgaaaggcgagugaggucuauuccuua

SEQ ID NO: 6117 - RNA, 37 nt, Artificial Sequence
  Description of Artificial Sequence:  Enzymatic Nucleic Acid
cuccagaggccgaaaggcgagugaggucucuggcauu

SEQ ID NO: 6118 - RNA, 37 nt, Artificial Sequence
  Description of Artificial Sequence:  Enzymatic Nucleic Acid
gggcccgagccgaaaggcgagugaggucuccuccaga

SEQ ID NO: 6119 - RNA, 37 nt, Artificial Sequence
  Description of Artificial Sequence:  Enzymatic Nucleic Acid
cgcccggggccgaaaggcgagugaggucuccgacccu

SEQ ID NO: 6120 - RNA, 37 nt, Artificial Sequence
  Description of Artificial Sequence:  Enzymatic Nucleic Acid
gcuggccggccgaaaggcgagugaggucuccgggccc

SEQ ID NO: 6121 - RNA, 37 nt, Artificial Sequence
  Description of Artificial Sequence:  Enzymatic Nucleic Acid
cucgcugggccgaaaggcgagugaggucucgcccggg

SEQ ID NO: 6122 - RNA, 37 nt, Artificial Sequence
  Description of Artificial Sequence:  Enzymatic Nucleic Acid
ccugcucggccgaaaggcgagugaggucuuggccgcc

SEQ ID NO: 6123 - RNA, 37 nt, Artificial Sequence
  Description of Artificial Sequence:  Enzymatic Nucleic Acid
cgcgccuggccgaaaggcgagugaggucuucgcuggc

SEQ ID NO: 6124 - RNA, 37 nt, Artificial Sequence
  Description of Artificial Sequence:  Enzymatic Nucleic Acid
cugccgcggccgaaaggcgagugaggucucugcucgc

SEQ ID NO: 6125 - RNA, 37 nt, Artificial Sequence
  Description of Artificial Sequence:  Enzymatic Nucleic Acid
agcugccggccgaaaggcgagugaggucugccugcuc

SEQ ID NO: 6126 - RNA, 37 nt, Artificial Sequence
  Description of Artificial Sequence:  Enzymatic Nucleic Acid
uccagcuggccgaaaggcgagugaggucucgcgccug

SEQ ID NO: 6127 - RNA, 37 nt, Artificial Sequence
  Description of Artificial Sequence:  Enzymatic Nucleic Acid
cucuccaggccgaaaggcgagugaggucuugccgcgc

SEQ ID NO: 6128 - RNA, 37 nt, Artificial Sequence
  Description of Artificial Sequence:  Enzymatic Nucleic Acid
cgcgcucagccgaaaggcgagugaggucuucuccagc

SEQ ID NO: 6129 - RNA, 37 nt, Artificial Sequence
  Description of Artificial Sequence:  Enzymatic Nucleic Acid
gccucgcggccgaaaggcgagugaggucuucacucuc

SEQ ID NO: 6130 - RNA, 37 nt, Artificial Sequence
  Description of Artificial Sequence:  Enzymatic Nucleic Acid
gcgccucggccgaaaggcgagugaggucugcucacuc

SEQ ID NO: 6131 - RNA, 37 nt, Artificial Sequence
  Description of Artificial Sequence:  Enzymatic Nucleic Acid
cugcagcggccgaaaggcgagugaggucucucgcgcu

SEQ ID NO: 6132 - RNA, 37 nt, Artificial Sequence
  Description of Artificial Sequence:  Enzymatic Nucleic Acid
ugcugcaggccgaaaggcgagugaggucugccucgcg

SEQ ID NO: 6133 - RNA, 37 nt, Artificial Sequence
  Description of Artificial Sequence:  Enzymatic Nucleic Acid
ugcugcuggccgaaaggcgagugaggucuagcgccuc

SEQ ID NO: 6134 - RNA, 37 nt, Artificial Sequence
  Description of Artificial Sequence:  Enzymatic Nucleic Acid
ugcugcuggccgaaaggcgagugaggucuugcagcgc

SEQ ID NO: 6135 - RNA, 37 nt, Artificial Sequence
  Description of Artificial Sequence:  Enzymatic Nucleic Acid
cugugcuggccgaaaggcgagugaggucuugcugcag

SEQ ID NO: 6136 - RNA, 37 nt, Artificial Sequence
  Description of Artificial Sequence:  Enzymatic Nucleic Acid
acgcuguggccgaaaggcgagugaggucuugcugcug

SEQ ID NO: 6137 - RNA, 37 nt, Artificial Sequence
  Description of Artificial Sequence:  Enzymatic Nucleic Acid
ccugcacggccgaaaggcgagugaggucuugugcugc

SEQ ID NO: 6138 - RNA, 37 nt, Artificial Sequence
  Description of Artificial Sequence:  Enzymatic Nucleic Acid
caccugcagccgaaaggcgagugaggucugcugugcu

SEQ ID NO: 6139 - RNA, 37 nt, Artificial Sequence
  Description of Artificial Sequence:  Enzymatic Nucleic Acid
uccaccuggccgaaaggcgagugaggucuacgcugug

SEQ ID NO: 6140 - RNA, 37 nt, Artificial Sequence
  Description of Artificial Sequence:  Enzymatic Nucleic Acid
cugguccagccgaaaggcgagugaggucucugcacgc

SEQ ID NO: 6141 - RNA, 37 nt, Artificial Sequence
  Description of Artificial Sequence:  Enzymatic Nucleic Acid
augcgcaggccgaaaggcgagugaggucuugguccac

SEQ ID NO: 6142 - RNA, 37 nt, Artificial Sequence
  Description of Artificial Sequence:  Enzymatic Nucleic Acid
ugcaugcggccgaaaggcgagugaggucuagcugguc

SEQ ID NO: 6143 - RNA, 37 nt, Artificial Sequence
  Description of Artificial Sequence:  Enzymatic Nucleic Acid
ccugcauggccgaaaggcgagugaggucugcagcugg

SEQ ID NO: 6144 - RNA, 37 nt, Artificial Sequence
  Description of Artificial Sequence:  Enzymatic Nucleic Acid
uggcccuggccgaaaggcgagugaggucuaugcgcag

SEQ ID NO: 6145 - RNA, 37 nt, Artificial Sequence
  Description of Artificial Sequence:  Enzymatic Nucleic Acid
cgcucugggccgaaaggcgagugaggucuccugcaug

SEQ ID NO: 6146 - RNA, 37 nt, Artificial Sequence
  Description of Artificial Sequence:  Enzymatic Nucleic Acid
ccuccacggccgaaaggcgagugaggucuucuggccc

SEQ ID NO: 6147 - RNA, 37 nt, Artificial Sequence
  Description of Artificial Sequence:  Enzymatic Nucleic Acid
ggccuccagccgaaaggcgagugaggucugcucuggc

SEQ ID NO: 6148 - RNA, 37 nt, Artificial Sequence
  Description of Artificial Sequence:  Enzymatic Nucleic Acid
gagcgcgggccgaaaggcgagugaggucucuccacgc

SEQ ID NO: 6149 - RNA, 37 nt, Artificial Sequence
  Description of Artificial Sequence:  Enzymatic Nucleic Acid
gcggagcggccgaaaggcgagugaggucuggccucca

SEQ ID NO: 6150 - RNA, 37 nt, Artificial Sequence
  Description of Artificial Sequence:  Enzymatic Nucleic Acid
augcggaggccgaaaggcgagugaggucugcggccuc

SEQ ID NO: 6151 - RNA, 37 nt, Artificial Sequence
  Description of Artificial Sequence:  Enzymatic Nucleic Acid
gcuccauggccgaaaggcgagugaggucuggagcgcg

SEQ ID NO: 6152 - RNA, 37 nt, Artificial Sequence
  Description of Artificial Sequence:  Enzymatic Nucleic Acid
gccuggcggccgaaaggcgagugaggucuuccaugcg

SEQ ID NO: 6153 - RNA, 37 nt, Artificial Sequence
  Description of Artificial Sequence:  Enzymatic Nucleic Acid
cggccugggccgaaaggcgagugaggucugcuccaug

SEQ ID NO: 6154 - RNA, 37 nt, Artificial Sequence
  Description of Artificial Sequence:  Enzymatic Nucleic Acid
cgaggcgggccgaaaggcgagugaggucucuggcgcu

SEQ ID NO: 6155 - RNA, 37 nt, Artificial Sequence
  Description of Artificial Sequence:  Enzymatic Nucleic Acid
cuccgagggccgaaaggcgagugaggucuggccuggc

SEQ ID NO: 6156 - RNA, 37 nt, Artificial Sequence
  Description of Artificial Sequence:  Enzymatic Nucleic Acid
ugggccaggccgaaaggcgagugaggucuuuccucuu

SEQ ID NO: 6157 - RNA, 37 nt, Artificial Sequence
  Description of Artificial Sequence:  Enzymatic Nucleic Acid
caacuggggccgaaaggcgagugaggucucagcuucc

SEQ ID NO: 6158 - RNA, 37 nt, Artificial Sequence
  Description of Artificial Sequence:  Enzymatic Nucleic Acid
accugcaagccgaaaggcgagugaggucuugggccag

SEQ ID NO: 6159 - RNA, 37 nt, Artificial Sequence
  Description of Artificial Sequence:  Enzymatic Nucleic Acid
gccaccuggccgaaaggcgagugaggucuaacugggc

SEQ ID NO: 6160 - RNA, 37 nt, Artificial Sequence
  Description of Artificial Sequence:  Enzymatic Nucleic Acid
auaggccagccgaaaggcgagugaggucucugcaacu

SEQ ID NO: 6161 - RNA, 37 nt, Artificial Sequence
  Description of Artificial Sequence:  Enzymatic Nucleic Acid
gugauagggccgaaaggcgagugaggucucaccugca

SEQ ID NO: 6162 - RNA, 37 nt, Artificial Sequence
  Description of Artificial Sequence:  Enzymatic Nucleic Acid
uggaagaggccgaaaggcgagugaggucuuggugaua

SEQ ID NO: 6163 - RNA, 37 nt, Artificial Sequence
  Description of Artificial Sequence:  Enzymatic Nucleic Acid
ccacgcuggccgaaaggcgagugaggucuucuugaug

SEQ ID NO: 6164 - RNA, 37 nt, Artificial Sequence
  Description of Artificial Sequence:  Enzymatic Nucleic Acid
ccaccacggccgaaaggcgagugaggucuugcucuug

SEQ ID NO: 6165 - RNA, 37 nt, Artificial Sequence
  Description of Artificial Sequence:  Enzymatic Nucleic Acid
gcccaccagccgaaaggcgagugaggucugcugcucu

SEQ ID NO: 6166 - RNA, 37 nt, Artificial Sequence
  Description of Artificial Sequence:  Enzymatic Nucleic Acid
acugcccagccgaaaggcgagugaggucucacgcugc

SEQ ID NO: 6167 - RNA, 37 nt, Artificial Sequence
  Description of Artificial Sequence:  Enzymatic Nucleic Acid
gcucacuggccgaaaggcgagugaggucuccaccacg

SEQ ID NO: 6168 - RNA, 37 nt, Artificial Sequence
  Description of Artificial Sequence:  Enzymatic Nucleic Acid
uccgcucagccgaaaggcgagugaggucuugcccacc

SEQ ID NO: 6169 - RNA, 37 nt, Artificial Sequence
  Description of Artificial Sequence:  Enzymatic Nucleic Acid
cgcuuccggccgaaaggcgagugaggucuucacugcc

SEQ ID NO: 6170 - RNA, 37 nt, Artificial Sequence
  Description of Artificial Sequence:  Enzymatic Nucleic Acid
auuccucggccgaaaggcgagugaggucuuuccgcuc

SEQ ID NO: 6171 - RNA, 37 nt, Artificial Sequence
  Description of Artificial Sequence:  Enzymatic Nucleic Acid
uccagcuggccgaaaggcgagugaggucuauuccucg

SEQ ID NO: 6172 - RNA, 37 nt, Artificial Sequence
  Description of Artificial Sequence:  Enzymatic Nucleic Acid
ucuuccaggccgaaaggcgagugaggucuugcauucc

SEQ ID NO: 6173 - RNA, 37 nt, Artificial Sequence
  Description of Artificial Sequence:  Enzymatic Nucleic Acid
uggagcuggccgaaaggcgagugaggucuuguuugag

SEQ ID NO: 6174 - RNA, 37 nt, Artificial Sequence
  Description of Artificial Sequence:  Enzymatic Nucleic Acid
ugcuggaggccgaaaggcgagugaggucuugcuguuu

SEQ ID NO: 6175 - RNA, 37 nt, Artificial Sequence
  Description of Artificial Sequence:  Enzymatic Nucleic Acid
ucggccuggccgaaaggcgagugaggucuuggagcug

SEQ ID NO: 6176 - RNA, 37 nt, Artificial Sequence
  Description of Artificial Sequence:  Enzymatic Nucleic Acid
cuccucgggccgaaaggcgagugaggucucugcugga

SEQ ID NO: 6177 - RNA, 37 nt, Artificial Sequence
  Description of Artificial Sequence:  Enzymatic Nucleic Acid
caccaggggccgaaaggcgagugaggucucuccucgg

SEQ ID NO: 6178 - RNA, 37 nt, Artificial Sequence
  Description of Artificial Sequence:  Enzymatic Nucleic Acid
uuuggccagccgaaaggcgagugaggucucagggccu

SEQ ID NO: 6179 - RNA, 37 nt, Artificial Sequence
  Description of Artificial Sequence:  Enzymatic Nucleic Acid
cuguuugggccgaaaggcgagugaggucucaccaggg

SEQ ID NO: 6180 - RNA, 37 nt, Artificial Sequence
  Description of Artificial Sequence:  Enzymatic Nucleic Acid
aucgaucagccgaaaggcgagugaggucucuccuguu

SEQ ID NO: 6181 - RNA, 37 nt, Artificial Sequence
  Description of Artificial Sequence:  Enzymatic Nucleic Acid
uccuucaggccgaaaggcgagugaggucuuuaucgau

SEQ ID NO: 6182 - RNA, 37 nt, Artificial Sequence
  Description of Artificial Sequence:  Enzymatic Nucleic Acid
cugcucgggccgaaaggcgagugaggucucuccuccu

SEQ ID NO: 6183 - RNA, 37 nt, Artificial Sequence
  Description of Artificial Sequence:  Enzymatic Nucleic Acid
uugugcuggccgaaaggcgagugaggucuucggccuc

SEQ ID NO: 6184 - RNA, 37 nt, Artificial Sequence
  Description of Artificial Sequence:  Enzymatic Nucleic Acid
aucuuguggccgaaaggcgagugaggucuugcucggc

SEQ ID NO: 6185 - RNA, 37 nt, Artificial Sequence
  Description of Artificial Sequence:  Enzymatic Nucleic Acid
cuccaucagccgaaaggcgagugaggucuaaucuugu

SEQ ID NO: 6186 - RNA, 37 nt, Artificial Sequence
  Description of Artificial Sequence:  Enzymatic Nucleic Acid
caccggaagccgaaaggcgagugaggucuggucucca

SEQ ID NO: 6187 - RNA, 37 nt, Artificial Sequence
  Description of Artificial Sequence:  Enzymatic Nucleic Acid
cuucagcagccgaaaggcgagugaggucucggaacgg

SEQ ID NO: 6188 - RNA, 37 nt, Artificial Sequence
  Description of Artificial Sequence:  Enzymatic Nucleic Acid
gccuucaggccgaaaggcgagugaggucuaccggaac

SEQ ID NO: 6189 - RNA, 37 nt, Artificial Sequence
  Description of Artificial Sequence:  Enzymatic Nucleic Acid
cgccuggggccgaaaggcgagugaggucucuucagca

SEQ ID NO: 6190 - RNA, 37 nt, Artificial Sequence
  Description of Artificial Sequence:  Enzymatic Nucleic Acid
gauauccggccgaaaggcgagugaggucucugggccu

SEQ ID NO: 6191 - RNA, 37 nt, Artificial Sequence
  Description of Artificial Sequence:  Enzymatic Nucleic Acid
gaaguccggccgaaaggcgagugaggucucuuguaga

SEQ ID NO: 6192 - RNA, 37 nt, Artificial Sequence
  Description of Artificial Sequence:  Enzymatic Nucleic Acid
ccucucaggccgaaaggcgagugaggucucuggaagu

SEQ ID NO: 6193 - RNA, 37 nt, Artificial Sequence
  Description of Artificial Sequence:  Enzymatic Nucleic Acid
cgggccuggccgaaaggcgagugaggucucucucagc

SEQ ID NO: 6194 - RNA, 37 nt, Artificial Sequence
  Description of Artificial Sequence:  Enzymatic Nucleic Acid
cucccggggccgaaaggcgagugaggucucugccucu

SEQ ID NO: 6195 - RNA, 37 nt, Artificial Sequence
  Description of Artificial Sequence:  Enzymatic Nucleic Acid
ucggccaggccgaaaggcgagugaggucuuucucccg

SEQ ID NO: 6196 - RNA, 37 nt, Artificial Sequence
  Description of Artificial Sequence:  Enzymatic Nucleic Acid
cuucucgggccgaaaggcgagugaggucucagcuucu

SEQ ID NO: 6197 - RNA, 37 nt, Artificial Sequence
  Description of Artificial Sequence:  Enzymatic Nucleic Acid
ugcaggaggccgaaaggcgagugaggucuuccuucuu

SEQ ID NO: 6198 - RNA, 37 nt, Artificial Sequence
  Description of Artificial Sequence:  Enzymatic Nucleic Acid
ugcuccuggccgaaaggcgagugaggucuaggagcuc

SEQ ID NO: 6199 - RNA, 37 nt, Artificial Sequence
  Description of Artificial Sequence:  Enzymatic Nucleic Acid
uccagcuggccgaaaggcgagugaggucuuccugcag

SEQ ID NO: 6200 - RNA, 37 nt, Artificial Sequence
  Description of Artificial Sequence:  Enzymatic Nucleic Acid
ugcuccaggccgaaaggcgagugaggucuugcuccug

SEQ ID NO: 6201 - RNA, 37 nt, Artificial Sequence
  Description of Artificial Sequence:  Enzymatic Nucleic Acid
ugcagcuggccgaaaggcgagugaggucuuccagcug

SEQ ID NO: 6202 - RNA, 37 nt, Artificial Sequence
  Description of Artificial Sequence:  Enzymatic Nucleic Acid
cucugcaggccgaaaggcgagugaggucuugcuccag

SEQ ID NO: 6203 - RNA, 37 nt, Artificial Sequence
  Description of Artificial Sequence:  Enzymatic Nucleic Acid
ucccucuggccgaaaggcgagugaggucuagcugcuc

SEQ ID NO: 6204 - RNA, 37 nt, Artificial Sequence
  Description of Artificial Sequence:  Enzymatic Nucleic Acid
uugcuguagccgaaaggcgagugaggucuucccucug

SEQ ID NO: 6205 - RNA, 37 nt, Artificial Sequence
  Description of Artificial Sequence:  Enzymatic Nucleic Acid
ucaguuuggccgaaaggcgagugaggucuuguacucc

SEQ ID NO: 6206 - RNA, 37 nt, Artificial Sequence
  Description of Artificial Sequence:  Enzymatic Nucleic Acid
acagcugggccgaaaggcgagugaggucucuucaguu

SEQ ID NO: 6207 - RNA, 37 nt, Artificial Sequence
  Description of Artificial Sequence:  Enzymatic Nucleic Acid
ccugacaggccgaaaggcgagugaggucuuggccuuc

SEQ ID NO: 6208 - RNA, 37 nt, Artificial Sequence
  Description of Artificial Sequence:  Enzymatic Nucleic Acid
acuccugagccgaaaggcgagugaggucuagcuggcc

SEQ ID NO: 6209 - RNA, 37 nt, Artificial Sequence
  Description of Artificial Sequence:  Enzymatic Nucleic Acid
cuggccgagccgaaaggcgagugaggucuuccugaca

SEQ ID NO: 6210 - RNA, 37 nt, Artificial Sequence
  Description of Artificial Sequence:  Enzymatic Nucleic Acid
gauccugggccgaaaggcgagugaggucucgacuccu

SEQ ID NO: 6211 - RNA, 37 nt, Artificial Sequence
  Description of Artificial Sequence:  Enzymatic Nucleic Acid
acaugccggccgaaaggcgagugaggucuuuccucau

SEQ ID NO: 6212 - RNA, 37 nt, Artificial Sequence
  Description of Artificial Sequence:  Enzymatic Nucleic Acid
ucgacauggccgaaaggcgagugaggucucgcuuccu

SEQ ID NO: 6213 - RNA, 37 nt, Artificial Sequence
  Description of Artificial Sequence:  Enzymatic Nucleic Acid
gaccucgagccgaaaggcgagugaggucuaugccgcu

SEQ ID NO: 6214 - RNA, 37 nt, Artificial Sequence
  Description of Artificial Sequence:  Enzymatic Nucleic Acid
cugggagagccgaaaggcgagugaggucucucgacau

SEQ ID NO: 6215 - RNA, 37 nt, Artificial Sequence
  Description of Artificial Sequence:  Enzymatic Nucleic Acid
caaggggggccgaaaggcgagugaggucucugggaga

SEQ ID NO: 6216 - RNA, 37 nt, Artificial Sequence
  Description of Artificial Sequence:  Enzymatic Nucleic Acid
gcgggggggccgaaaggcgagugaggucuaagggggc

SEQ ID NO: 6217 - RNA, 37 nt, Artificial Sequence
  Description of Artificial Sequence:  Enzymatic Nucleic Acid
ggcagggggccgaaaggcgagugaggucuggggggca

SEQ ID NO: 6218 - RNA, 37 nt, Artificial Sequence
  Description of Artificial Sequence:  Enzymatic Nucleic Acid
gagguagggccgaaaggcgagugaggucuaggggcgg

SEQ ID NO: 6219 - RNA, 37 nt, Artificial Sequence
  Description of Artificial Sequence:  Enzymatic Nucleic Acid
gggcaggggccgaaaggcgagugaggucucaggggag

SEQ ID NO: 6220 - RNA, 37 nt, Artificial Sequence
  Description of Artificial Sequence:  Enzymatic Nucleic Acid
uggcuggggccgaaaggcgagugaggucuagggccag

SEQ ID NO: 6221 - RNA, 37 nt, Artificial Sequence
  Description of Artificial Sequence:  Enzymatic Nucleic Acid
uccucugggccgaaaggcgagugaggucuugggcagg

SEQ ID NO: 6222 - RNA, 37 nt, Artificial Sequence
  Description of Artificial Sequence:  Enzymatic Nucleic Acid
cggggggggccgaaaggcgagugaggucuuccuccuc

SEQ ID NO: 6223 - RNA, 37 nt, Artificial Sequence
  Description of Artificial Sequence:  Enzymatic Nucleic Acid
ucaggugggccgaaaggcgagugaggucuuccucggg

SEQ ID NO: 6224 - RNA, 37 nt, Artificial Sequence
  Description of Artificial Sequence:  Enzymatic Nucleic Acid
ugggacaggccgaaaggcgagugaggucuagaaguca

SEQ ID NO: 6225 - RNA, 37 nt, Artificial Sequence
  Description of Artificial Sequence:  Enzymatic Nucleic Acid
acuugggagccgaaaggcgagugaggucuagcagaag

SEQ ID NO: 6226 - RNA, 37 nt, Artificial Sequence
  Description of Artificial Sequence:  Enzymatic Nucleic Acid
uacuggcagccgaaaggcgagugaggucuuugggaca

SEQ ID NO: 6227 - RNA, 37 nt, Artificial Sequence
  Description of Artificial Sequence:  Enzymatic Nucleic Acid
gauacugggccgaaaggcgagugaggucuacuuggga

SEQ ID NO: 6228 - RNA, 37 nt, Artificial Sequence
  Description of Artificial Sequence:  Enzymatic Nucleic Acid
gccugauagccgaaaggcgagugaggucuuggcacuu

SEQ ID NO: 6229 - RNA, 37 nt, Artificial Sequence
  Description of Artificial Sequence:  Enzymatic Nucleic Acid
aucagggggccgaaaggcgagugaggucucugauacu

SEQ ID NO: 6230 - RNA, 37 nt, Artificial Sequence
  Description of Artificial Sequence:  Enzymatic Nucleic Acid
uguaucuggccgaaaggcgagugaggucuaggguguc

SEQ ID NO: 6231 - RNA, 37 nt, Artificial Sequence
  Description of Artificial Sequence:  Enzymatic Nucleic Acid
cuccaugagccgaaaggcgagugaggucuauguaucu

SEQ ID NO: 6232 - RNA, 37 nt, Artificial Sequence
  Description of Artificial Sequence:  Enzymatic Nucleic Acid
ucaaugcagccgaaaggcgagugaggucuuccaugac

SEQ ID NO: 6233 - RNA, 37 nt, Artificial Sequence
  Description of Artificial Sequence:  Enzymatic Nucleic Acid
acucaauggccgaaaggcgagugaggucuacuccaug

SEQ ID NO: 6234 - RNA, 37 nt, Artificial Sequence
  Description of Artificial Sequence:  Enzymatic Nucleic Acid
cggcccuagccgaaaggcgagugaggucuucaaugca

SEQ ID NO: 6235 - RNA, 37 nt, Artificial Sequence
  Description of Artificial Sequence:  Enzymatic Nucleic Acid
cuggccgggccgaaaggcgagugaggucuccuacuca

SEQ ID NO: 6236 - RNA, 37 nt, Artificial Sequence
  Description of Artificial Sequence:  Enzymatic Nucleic Acid
ugcacugggccgaaaggcgagugaggucucggcccua

SEQ ID NO: 6237 - RNA, 37 nt, Artificial Sequence
  Description of Artificial Sequence:  Enzymatic Nucleic Acid
gccuugcagccgaaaggcgagugaggucuuggccggc

SEQ ID NO: 6238 - RNA, 37 nt, Artificial Sequence
  Description of Artificial Sequence:  Enzymatic Nucleic Acid
uggccuuggccgaaaggcgagugaggucuacuggccg

SEQ ID NO: 6239 - RNA, 37 nt, Artificial Sequence
  Description of Artificial Sequence:  Enzymatic Nucleic Acid
ggcagugggccgaaaggcgagugaggucucuugcacu

SEQ ID NO: 6240 - RNA, 37 nt, Artificial Sequence
  Description of Artificial Sequence:  Enzymatic Nucleic Acid
cgggcagggccgaaaggcgagugaggucuaguggccu

SEQ ID NO: 6241 - RNA, 37 nt, Artificial Sequence
  Description of Artificial Sequence:  Enzymatic Nucleic Acid
uccucggggccgaaaggcgagugaggucuaggcagug

SEQ ID NO: 6242 - RNA, 37 nt, Artificial Sequence
  Description of Artificial Sequence:  Enzymatic Nucleic Acid
cccgggcagccgaaaggcgagugaggucuguccucgg

SEQ ID NO: 6243 - RNA, 37 nt, Artificial Sequence
  Description of Artificial Sequence:  Enzymatic Nucleic Acid
gucccggggccgaaaggcgagugaggucuacguccuc

SEQ ID NO: 6244 - RNA, 37 nt, Artificial Sequence
  Description of Artificial Sequence:  Enzymatic Nucleic Acid
agacugcagccgaaaggcgagugaggucuggucccgg

SEQ ID NO: 6245 - RNA, 37 nt, Artificial Sequence
  Description of Artificial Sequence:  Enzymatic Nucleic Acid
gcagacuggccgaaaggcgagugaggucuacgguccc

SEQ ID NO: 6246 - RNA, 37 nt, Artificial Sequence
  Description of Artificial Sequence:  Enzymatic Nucleic Acid
agcgcagagccgaaaggcgagugaggucuugcacggu

SEQ ID NO: 6247 - RNA, 37 nt, Artificial Sequence
  Description of Artificial Sequence:  Enzymatic Nucleic Acid
ggaaagcggccgaaaggcgagugaggucuagacugca

SEQ ID NO: 6248 - RNA, 37 nt, Artificial Sequence
  Description of Artificial Sequence:  Enzymatic Nucleic Acid
gaggaaaggccgaaaggcgagugaggucugcagacug

SEQ ID NO: 6249 - RNA, 37 nt, Artificial Sequence
  Description of Artificial Sequence:  Enzymatic Nucleic Acid
uaggcagggccgaaaggcgagugaggucugggagagg

SEQ ID NO: 6250 - RNA, 37 nt, Artificial Sequence
  Description of Artificial Sequence:  Enzymatic Nucleic Acid
gggcuagggccgaaaggcgagugaggucuaggcggga

SEQ ID NO: 6251 - RNA, 37 nt, Artificial Sequence
  Description of Artificial Sequence:  Enzymatic Nucleic Acid
auccuggggccgaaaggcgagugaggucuuaggcagg

SEQ ID NO: 6252 - RNA, 37 nt, Artificial Sequence
  Description of Artificial Sequence:  Enzymatic Nucleic Acid
ccacccaggccgaaaggcgagugaggucuccuucauc

SEQ ID NO: 6253 - RNA, 37 nt, Artificial Sequence
  Description of Artificial Sequence:  Enzymatic Nucleic Acid
uguggccagccgaaaggcgagugaggucuccagcccu

SEQ ID NO: 6254 - RNA, 37 nt, Artificial Sequence
  Description of Artificial Sequence:  Enzymatic Nucleic Acid
aguugugggccgaaaggcgagugaggucucacccagc

SEQ ID NO: 6255 - RNA, 37 nt, Artificial Sequence
  Description of Artificial Sequence:  Enzymatic Nucleic Acid
ccaggugggccgaaaggcgagugaggucuaucccagu

SEQ ID NO: 6256 - RNA, 37 nt, Artificial Sequence
  Description of Artificial Sequence:  Enzymatic Nucleic Acid
gggugggggccgaaaggcgagugaggucuuccaggug

SEQ ID NO: 6257 - RNA, 37 nt, Artificial Sequence
  Description of Artificial Sequence:  Enzymatic Nucleic Acid
gcggccaggccgaaaggcgagugaggucuuccugggu

SEQ ID NO: 6258 - RNA, 37 nt, Artificial Sequence
  Description of Artificial Sequence:  Enzymatic Nucleic Acid
ugccgcgggccgaaaggcgagugaggucucagcuccu

SEQ ID NO: 6259 - RNA, 37 nt, Artificial Sequence
  Description of Artificial Sequence:  Enzymatic Nucleic Acid
aggugccggccgaaaggcgagugaggucuggccagcu

SEQ ID NO: 6260 - RNA, 37 nt, Artificial Sequence
  Description of Artificial Sequence:  Enzymatic Nucleic Acid
guaagguggccgaaaggcgagugaggucucgcggcca

SEQ ID NO: 6261 - RNA, 37 nt, Artificial Sequence
  Description of Artificial Sequence:  Enzymatic Nucleic Acid
agcugaaggccgaaaggcgagugaggucuguaaggug

SEQ ID NO: 6262 - RNA, 37 nt, Artificial Sequence
  Description of Artificial Sequence:  Enzymatic Nucleic Acid
aucaacaggccgaaaggcgagugaggucuugaagcgu

SEQ ID NO: 6263 - RNA, 37 nt, Artificial Sequence
  Description of Artificial Sequence:  Enzymatic Nucleic Acid
cggaucaagccgaaaggcgagugaggucuagcugaag

SEQ ID NO: 6264 - RNA, 37 nt, Artificial Sequence
  Description of Artificial Sequence:  Enzymatic Nucleic Acid
gggaccaggccgaaaggcgagugaggucuggaucaac

SEQ ID NO: 6265 - RNA, 37 nt, Artificial Sequence
  Description of Artificial Sequence:  Enzymatic Nucleic Acid
agaggggagccgaaaggcgagugaggucucagcggau

SEQ ID NO: 6266 - RNA, 37 nt, Artificial Sequence
  Description of Artificial Sequence:  Enzymatic Nucleic Acid
cgcaucuagccgaaaggcgagugaggucucccaaaag

SEQ ID NO: 6267 - RNA, 37 nt, Artificial Sequence
  Description of Artificial Sequence:  Enzymatic Nucleic Acid
cggggccggccgaaaggcgagugaggucuaucuaccc

SEQ ID NO: 6268 - RNA, 37 nt, Artificial Sequence
  Description of Artificial Sequence:  Enzymatic Nucleic Acid
gaucgggggccgaaaggcgagugaggucucgcaucua

SEQ ID NO: 6269 - RNA, 37 nt, Artificial Sequence
  Description of Artificial Sequence:  Enzymatic Nucleic Acid
gagucagggccgaaaggcgagugaggucucugaucgg

SEQ ID NO: 6270 - RNA, 37 nt, Artificial Sequence
  Description of Artificial Sequence:  Enzymatic Nucleic Acid
aagagcaggccgaaaggcgagugaggucugagucagg

SEQ ID NO: 6271 - RNA, 37 nt, Artificial Sequence
  Description of Artificial Sequence:  Enzymatic Nucleic Acid
aaaaagaggccgaaaggcgagugaggucuagcgaguc

SEQ ID NO: 6272 - RNA, 37 nt, Artificial Sequence
  Description of Artificial Sequence:  Enzymatic Nucleic Acid
gaagggaagccgaaaggcgagugaggucuaaaaagag

SEQ ID NO: 6273 - RNA, 37 nt, Artificial Sequence
  Description of Artificial Sequence:  Enzymatic Nucleic Acid
cgagcagagccgaaaggcgagugaggucuagaaggga

SEQ ID NO: 6274 - RNA, 37 nt, Artificial Sequence
  Description of Artificial Sequence:  Enzymatic Nucleic Acid
gguucgaggccgaaaggcgagugaggucuagacagaa

SEQ ID NO: 6275 - RNA, 37 nt, Artificial Sequence
  Description of Artificial Sequence:  Enzymatic Nucleic Acid
gcccgagggccgaaaggcgagugaggucuaagugguu

SEQ ID NO: 6276 - RNA, 37 nt, Artificial Sequence
  Description of Artificial Sequence:  Enzymatic Nucleic Acid
gggauuaggccgaaaggcgagugaggucuccgaggca

SEQ ID NO: 6277 - RNA, 37 nt, Artificial Sequence
  Description of Artificial Sequence:  Enzymatic Nucleic Acid
ccccaguggccgaaaggcgagugaggucucgggugga

SEQ ID NO: 6278 - RNA, 37 nt, Artificial Sequence
  Description of Artificial Sequence:  Enzymatic Nucleic Acid
auucuugagccgaaaggcgagugaggucuuuccccag

SEQ ID NO: 6279 - RNA, 37 nt, Artificial Sequence
  Description of Artificial Sequence:  Enzymatic Nucleic Acid
gccccagggccgaaaggcgagugaggucucccauucu

SEQ ID NO: 6280 - RNA, 37 nt, Artificial Sequence
  Description of Artificial Sequence:  Enzymatic Nucleic Acid
ccugagaggccgaaaggcgagugaggucucccaggcc

SEQ ID NO: 6281 - RNA, 37 nt, Artificial Sequence
  Description of Artificial Sequence:  Enzymatic Nucleic Acid
aggggaaggccgaaaggcgagugaggucuaguucucc

SEQ ID NO: 6282 - RNA, 37 nt, Artificial Sequence
  Description of Artificial Sequence:  Enzymatic Nucleic Acid
cagcucuggccgaaaggcgagugaggucucaggggaa

SEQ ID NO: 6283 - RNA, 37 nt, Artificial Sequence
  Description of Artificial Sequence:  Enzymatic Nucleic Acid
ccacccaggccgaaaggcgagugaggucuucugccag

SEQ ID NO: 6284 - RNA, 37 nt, Artificial Sequence
  Description of Artificial Sequence:  Enzymatic Nucleic Acid
agcugccagccgaaaggcgagugaggucuccagcucu

SEQ ID NO: 6285 - RNA, 37 nt, Artificial Sequence
  Description of Artificial Sequence:  Enzymatic Nucleic Acid
aagagcuggccgaaaggcgagugaggucucacccagc

SEQ ID NO: 6286 - RNA, 37 nt, Artificial Sequence
  Description of Artificial Sequence:  Enzymatic Nucleic Acid
aggaagaggccgaaaggcgagugaggucuugccaccc

SEQ ID NO: 6287 - RNA, 37 nt, Artificial Sequence
  Description of Artificial Sequence:  Enzymatic Nucleic Acid
gcggcggggccgaaaggcgagugaggucugggucggu

SEQ ID NO: 6288 - RNA, 37 nt, Artificial Sequence
  Description of Artificial Sequence:  Enzymatic Nucleic Acid
cacagcgggccgaaaggcgagugaggucugggcgggu

SEQ ID NO: 6289 - RNA, 37 nt, Artificial Sequence
  Description of Artificial Sequence:  Enzymatic Nucleic Acid
gggcacaggccgaaaggcgagugaggucuggcgggcg

SEQ ID NO: 6290 - RNA, 37 nt, Artificial Sequence
  Description of Artificial Sequence:  Enzymatic Nucleic Acid
ccagggcagccgaaaggcgagugaggucuagcggcgg

SEQ ID NO: 6291 - RNA, 37 nt, Artificial Sequence
  Description of Artificial Sequence:  Enzymatic Nucleic Acid
ucccaggggccgaaaggcgagugaggucuacagcggc

SEQ ID NO: 6292 - RNA, 37 nt, Artificial Sequence
  Description of Artificial Sequence:  Enzymatic Nucleic Acid
gggcagcagccgaaaggcgagugaggucuucccaggg

SEQ ID NO: 6293 - RNA, 37 nt, Artificial Sequence
  Description of Artificial Sequence:  Enzymatic Nucleic Acid
gagggcaggccgaaaggcgagugaggucuacucccag

SEQ ID NO: 6294 - RNA, 37 nt, Artificial Sequence
  Description of Artificial Sequence:  Enzymatic Nucleic Acid
uaagaggggccgaaaggcgagugaggucuagcacucc

SEQ ID NO: 6295 - RNA, 37 nt, Artificial Sequence
  Description of Artificial Sequence:  Enzymatic Nucleic Acid
cccguguggccgaaaggcgagugaggucuaugguaag

SEQ ID NO: 6296 - RNA, 37 nt, Artificial Sequence
  Description of Artificial Sequence:  Enzymatic Nucleic Acid
ggagagcagccgaaaggcgagugaggucuccgugugc

SEQ ID NO: 6297 - RNA, 37 nt, Artificial Sequence
  Description of Artificial Sequence:  Enzymatic Nucleic Acid
aaggagaggccgaaaggcgagugaggucuacccgugu

SEQ ID NO: 6298 - RNA, 37 nt, Artificial Sequence
  Description of Artificial Sequence:  Enzymatic Nucleic Acid
gcaugcaggccgaaaggcgagugaggucuccaaaagg

SEQ ID NO: 6299 - RNA, 37 nt, Artificial Sequence
  Description of Artificial Sequence:  Enzymatic Nucleic Acid
auagcauggccgaaaggcgagugaggucuagcccaaa

SEQ ID NO: 6300 - RNA, 37 nt, Artificial Sequence
  Description of Artificial Sequence:  Enzymatic Nucleic Acid
uggaauaggccgaaaggcgagugaggucuaugcagcc

SEQ ID NO: 6301 - RNA, 37 nt, Artificial Sequence
  Description of Artificial Sequence:  Enzymatic Nucleic Acid
ucuggcuggccgaaaggcgagugaggucuaaaaugga

SEQ ID NO: 6302 - RNA, 37 nt, Artificial Sequence
  Description of Artificial Sequence:  Enzymatic Nucleic Acid
cggucugggccgaaaggcgagugaggucuugcaaaau

SEQ ID NO: 6303 - RNA, 37 nt, Artificial Sequence
  Description of Artificial Sequence:  Enzymatic Nucleic Acid
uaaauacagccgaaaggcgagugaggucuaucggucu

SEQ ID NO: 6304 - RNA, 37 nt, Artificial Sequence
  Description of Artificial Sequence:  Enzymatic Nucleic Acid
guuaaauagccgaaaggcgagugaggucuacaucggu

SEQ ID NO: 6305 - RNA, 37 nt, Artificial Sequence
  Description of Artificial Sequence:  Enzymatic Nucleic Acid
aauagugagccgaaaggcgagugaggucuugguuaaa

SEQ ID NO: 6306 - RNA, 37 nt, Artificial Sequence
  Description of Artificial Sequence:  Enzymatic Nucleic Acid
ggaaacaagccgaaaggcgagugaggucuccaaaugu

SEQ ID NO: 6307 - RNA, 37 nt, Artificial Sequence
  Description of Artificial Sequence:  Enzymatic Nucleic Acid
augggaaagccgaaaggcgagugaggucuaacccaaa

SEQ ID NO: 6308 - RNA, 37 nt, Artificial Sequence
  Description of Artificial Sequence:  Enzymatic Nucleic Acid
uaugguaagccgaaaggcgagugaggucuaaaaagau

SEQ ID NO: 6309 - RNA, 37 nt, Artificial Sequence
  Description of Artificial Sequence:  Enzymatic Nucleic Acid
uuacuauggccgaaaggcgagugaggucucauuauuu

SEQ ID NO: 6310 - RNA, 37 nt, Artificial Sequence
  Description of Artificial Sequence:  Enzymatic Nucleic Acid
uuuuuuuagccgaaaggcgagugaggucuuaugccau

SEQ ID NO: 6311 - RNA, 17 nt, Homo sapiens
cccuugugauccaggug

SEQ ID NO: 6312 - RNA, 17 nt, Homo sapiens
guggggaaacuaaggcc

SEQ ID NO: 6313 - RNA, 17 nt, Homo sapiens
aagugaggaccccgcag

SEQ ID NO: 6314 - RNA, 17 nt, Homo sapiens
ccccgcagacuaucaau

SEQ ID NO: 6315 - RNA, 17 nt, Homo sapiens
gacuaucaaucccaguc

SEQ ID NO: 6316 - RNA, 17 nt, Homo sapiens
ccuguuggaugaauagg

SEQ ID NO: 6317 - RNA, 17 nt, Homo sapiens
uuggaugaauaggcacc

SEQ ID NO: 6318 - RNA, 17 nt, Homo sapiens
aagagccaacuguguga

SEQ ID NO: 6319 - RNA, 17 nt, Homo sapiens
ugugugagauggugcag

SEQ ID NO: 6320 - RNA, 17 nt, Homo sapiens
ggcagcagaucaggacg

SEQ ID NO: 6321 - RNA, 17 nt, Homo sapiens
agaucaggacguacugg

SEQ ID NO: 6322 - RNA, 17 nt, Homo sapiens
ccuucagaacagggcgc

SEQ ID NO: 6323 - RNA, 17 nt, Homo sapiens
cuccugagacccuccag

SEQ ID NO: 6324 - RNA, 17 nt, Homo sapiens
ggaggagaaucaagagc

SEQ ID NO: 6325 - RNA, 17 nt, Homo sapiens
gcuccgagaugccaucc

SEQ ID NO: 6326 - RNA, 17 nt, Homo sapiens
gcagagcaaccagauuc

SEQ ID NO: 6327 - RNA, 17 nt, Homo sapiens
gcaaccagauucugcgg

SEQ ID NO: 6328 - RNA, 17 nt, Homo sapiens
gccaggaaacuggugga

SEQ ID NO: 6329 - RNA, 17 nt, Homo sapiens
guggagagacucggccu

SEQ ID NO: 6330 - RNA, 17 nt, Homo sapiens
gaagcucgaucugaaga

SEQ ID NO: 6331 - RNA, 17 nt, Homo sapiens
cugaagagaugccagca

SEQ ID NO: 6332 - RNA, 17 nt, Homo sapiens
agcagcagauggcugag

SEQ ID NO: 6333 - RNA, 17 nt, Homo sapiens
ggcugaggacaaggccu

SEQ ID NO: 6334 - RNA, 17 nt, Homo sapiens
cccaggugacguccuug

SEQ ID NO: 6335 - RNA, 17 nt, Homo sapiens
acuaaggaaugccaggc

SEQ ID NO: 6336 - RNA, 17 nt, Homo sapiens
gcagguggaccagcugc

SEQ ID NO: 6337 - RNA, 17 nt, Homo sapiens
uuccaagaauacgacaa

SEQ ID NO: 6338 - RNA, 17 nt, Homo sapiens
agaauacgacaaccaca

SEQ ID NO: 6339 - RNA, 17 nt, Homo sapiens
auacgacaaccacauca

SEQ ID NO: 6340 - RNA, 17 nt, Homo sapiens
agcgaggaaugcagcug

SEQ ID NO: 6341 - RNA, 17 nt, Homo sapiens
gcuggaagaucucaaac

SEQ ID NO: 6342 - RNA, 17 nt, Homo sapiens
gaucucaaacagcagcu

SEQ ID NO: 6343 - RNA, 17 nt, Homo sapiens
guggccaaacaggaggu

SEQ ID NO: 6344 - RNA, 17 nt, Homo sapiens
aggaggugaucgauaag

SEQ ID NO: 6345 - RNA, 17 nt, Homo sapiens
ggugaucgauaagcuga

SEQ ID NO: 6346 - RNA, 17 nt, Homo sapiens
agcacaagauugugaug

SEQ ID NO: 6347 - RNA, 17 nt, Homo sapiens
agauugugauggagacc

SEQ ID NO: 6348 - RNA, 17 nt, Homo sapiens
ugauggagaccguuccg

SEQ ID NO: 6349 - RNA, 17 nt, Homo sapiens
ccaggcggauaucuaca

SEQ ID NO: 6350 - RNA, 17 nt, Homo sapiens
caaggcggacuuccagg

SEQ ID NO: 6351 - RNA, 17 nt, Homo sapiens
uacagcaaacugaaggc

SEQ ID NO: 6352 - RNA, 17 nt, Homo sapiens
cggccaggaucgaggac

SEQ ID NO: 6353 - RNA, 17 nt, Homo sapiens
gaucgaggacaugagga

SEQ ID NO: 6354 - RNA, 17 nt, Homo sapiens
gccaccugacuucugcu

SEQ ID NO: 6355 - RNA, 17 nt, Homo sapiens
ggccccugauauggaca

SEQ ID NO: 6356 - RNA, 17 nt, Homo sapiens
ugauauggacacccugc

SEQ ID NO: 6357 - RNA, 17 nt, Homo sapiens
cccugcagauacauguc

SEQ ID NO: 6358 - RNA, 17 nt, Homo sapiens
gcccgaggacgugcccg

SEQ ID NO: 6359 - RNA, 17 nt, Homo sapiens
ugcccgggaccgugcag

SEQ ID NO: 6360 - RNA, 17 nt, Homo sapiens
agcccaggaugaagggc

SEQ ID NO: 6361 - RNA, 17 nt, Homo sapiens
uggccacaacugggaug

SEQ ID NO: 6362 - RNA, 17 nt, Homo sapiens
caacugggaugccaccu

SEQ ID NO: 6363 - RNA, 17 nt, Homo sapiens
agcuguugauccgcugg

SEQ ID NO: 6364 - RNA, 17 nt, Homo sapiens
ugggguagaugcggccc

SEQ ID NO: 6365 - RNA, 17 nt, Homo sapiens
cggccccgaucaggccu

SEQ ID NO: 6366 - RNA, 17 nt, Homo sapiens
caggccugacucgcugc

SEQ ID NO: 6367 - RNA, 17 nt, Homo sapiens
cugcucgaaccacuugc

SEQ ID NO: 6368 - RNA, 17 nt, Homo sapiens
ucgggcuaaucccuccc

SEQ ID NO: 6369 - RNA, 17 nt, Homo sapiens
agucaagaauggggccu

SEQ ID NO: 6370 - RNA, 17 nt, Homo sapiens
cagggagaacugcuucc

SEQ ID NO: 6371 - RNA, 17 nt, Homo sapiens
cccaccggacaccgacc

SEQ ID NO: 6372 - RNA, 17 nt, Homo sapiens
ggacaccgacccgcccg

SEQ ID NO: 6373 - RNA, 17 nt, Homo sapiens
gcagccagaccgaugug

SEQ ID NO: 6374 - RNA, 17 nt, Homo sapiens
ccagaccgauguguauu

SEQ ID NO: 6375 - RNA, 17 nt, Homo sapiens
uguauuuaaccagucac

SEQ ID NO: 6376 - RNA, 17 nt, Homo sapiens
cacuauugauggacauu

SEQ ID NO: 6377 - RNA, 17 nt, Homo sapiens
auugauggacauuuggg

SEQ ID NO: 6378 - RNA, 17 nt, Homo sapiens
uaccauaaauaauggca

SEQ ID NO: 6379 - RNA, 17 nt, Homo sapiens
cauaaauaauggcauag

SEQ ID NO: 6380 - DNA, 31 bp, Artificial Sequence
  Description of Artificial Sequence:  Enzymatic Nucleic Acid
aagggccaggctagctacaacgagctcgtgc

SEQ ID NO: 6381 - DNA, 31 bp, Artificial Sequence
  Description of Artificial Sequence:  Enzymatic Nucleic Acid
cacaagggggctagctacaacgacatgctcg

SEQ ID NO: 6382 - DNA, 31 bp, Artificial Sequence
  Description of Artificial Sequence:  Enzymatic Nucleic Acid
ctggatcaggctagctacaacgaaagggcca

SEQ ID NO: 6383 - DNA, 31 bp, Artificial Sequence
  Description of Artificial Sequence:  Enzymatic Nucleic Acid
cacctggaggctagctacaacgacacaaggg

SEQ ID NO: 6384 - DNA, 31 bp, Artificial Sequence
  Description of Artificial Sequence:  Enzymatic Nucleic Acid
tttccccaggctagctacaacgactggatca

SEQ ID NO: 6385 - DNA, 31 bp, Artificial Sequence
  Description of Artificial Sequence:  Enzymatic Nucleic Acid
ggccttagggctagctacaacgattccccac

SEQ ID NO: 6386 - DNA, 31 bp, Artificial Sequence
  Description of Artificial Sequence:  Enzymatic Nucleic Acid
tctctgggggctagctacaacgacttagttt

SEQ ID NO: 6387 - DNA, 31 bp, Artificial Sequence
  Description of Artificial Sequence:  Enzymatic Nucleic Acid
ggtcctcaggctagctacaacgattctctgg

SEQ ID NO: 6388 - DNA, 31 bp, Artificial Sequence
  Description of Artificial Sequence:  Enzymatic Nucleic Acid
ctgcggggggctagctacaacgacctcactt

SEQ ID NO: 6389 - DNA, 31 bp, Artificial Sequence
  Description of Artificial Sequence:  Enzymatic Nucleic Acid
atagtctgggctagctacaacgaggggtcct

SEQ ID NO: 6390 - DNA, 31 bp, Artificial Sequence
  Description of Artificial Sequence:  Enzymatic Nucleic Acid
attgatagggctagctacaacgactgcgggg

SEQ ID NO: 6391 - DNA, 31 bp, Artificial Sequence
  Description of Artificial Sequence:  Enzymatic Nucleic Acid
gggattgaggctagctacaacgaagtctgcg

SEQ ID NO: 6392 - DNA, 31 bp, Artificial Sequence
  Description of Artificial Sequence:  Enzymatic Nucleic Acid
gactgggaggctagctacaacgatgatagtc

SEQ ID NO: 6393 - DNA, 31 bp, Artificial Sequence
  Description of Artificial Sequence:  Enzymatic Nucleic Acid
ggaagagaggctagctacaacgatgggattg

SEQ ID NO: 6394 - DNA, 31 bp, Artificial Sequence
  Description of Artificial Sequence:  Enzymatic Nucleic Acid
acagggagggctagctacaacgagaggggaa

SEQ ID NO: 6395 - DNA, 31 bp, Artificial Sequence
  Description of Artificial Sequence:  Enzymatic Nucleic Acid
gagcttcaggctagctacaacgaagggagtg

SEQ ID NO: 6396 - DNA, 31 bp, Artificial Sequence
  Description of Artificial Sequence:  Enzymatic Nucleic Acid
ctggagagggctagctacaacgattcacagg

SEQ ID NO: 6397 - DNA, 31 bp, Artificial Sequence
  Description of Artificial Sequence:  Enzymatic Nucleic Acid
cgatgatgggctagctacaacgatggagagc

SEQ ID NO: 6398 - DNA, 31 bp, Artificial Sequence
  Description of Artificial Sequence:  Enzymatic Nucleic Acid
ctcgatgaggctagctacaacgagctggaga

SEQ ID NO: 6399 - DNA, 31 bp, Artificial Sequence
  Description of Artificial Sequence:  Enzymatic Nucleic Acid
gacctcgaggctagctacaacgagatgctgg

SEQ ID NO: 6400 - DNA, 31 bp, Artificial Sequence
  Description of Artificial Sequence:  Enzymatic Nucleic Acid
tgatgggaggctagctacaacgactcgatga

SEQ ID NO: 6401 - DNA, 31 bp, Artificial Sequence
  Description of Artificial Sequence:  Enzymatic Nucleic Acid
agggctgaggctagctacaacgagggacctc

SEQ ID NO: 6402 - DNA, 31 bp, Artificial Sequence
  Description of Artificial Sequence:  Enzymatic Nucleic Acid
ggcaagggggctagctacaacgatgatggga

SEQ ID NO: 6403 - DNA, 31 bp, Artificial Sequence
  Description of Artificial Sequence:  Enzymatic Nucleic Acid
caacagggggctagctacaacgaaagggctg

SEQ ID NO: 6404 - DNA, 31 bp, Artificial Sequence
  Description of Artificial Sequence:  Enzymatic Nucleic Acid
tcatccaaggctagctacaacgaagggcaag

SEQ ID NO: 6405 - DNA, 31 bp, Artificial Sequence
  Description of Artificial Sequence:  Enzymatic Nucleic Acid
cctattcaggctagctacaacgaccaacagg

SEQ ID NO: 6406 - DNA, 31 bp, Artificial Sequence
  Description of Artificial Sequence:  Enzymatic Nucleic Acid
ggtgcctaggctagctacaacgatcatccaa

SEQ ID NO: 6407 - DNA, 31 bp, Artificial Sequence
  Description of Artificial Sequence:  Enzymatic Nucleic Acid
cagaggtgggctagctacaacgactattcat

SEQ ID NO: 6408 - DNA, 31 bp, Artificial Sequence
  Description of Artificial Sequence:  Enzymatic Nucleic Acid
tccagaggggctagctacaacgagcctattc

SEQ ID NO: 6409 - DNA, 31 bp, Artificial Sequence
  Description of Artificial Sequence:  Enzymatic Nucleic Acid
acagttggggctagctacaacgatcttccag

SEQ ID NO: 6410 - DNA, 31 bp, Artificial Sequence
  Description of Artificial Sequence:  Enzymatic Nucleic Acid
tcacacagggctagctacaacgatggctctt

SEQ ID NO: 6411 - DNA, 31 bp, Artificial Sequence
  Description of Artificial Sequence:  Enzymatic Nucleic Acid
atctcacaggctagctacaacgaagttggct

SEQ ID NO: 6412 - DNA, 31 bp, Artificial Sequence
  Description of Artificial Sequence:  Enzymatic Nucleic Acid
ccatctcaggctagctacaacgaacagttgg

SEQ ID NO: 6413 - DNA, 31 bp, Artificial Sequence
  Description of Artificial Sequence:  Enzymatic Nucleic Acid
ctgcaccaggctagctacaacgactcacaca

SEQ ID NO: 6414 - DNA, 31 bp, Artificial Sequence
  Description of Artificial Sequence:  Enzymatic Nucleic Acid
gggctgcaggctagctacaacgacatctcac

SEQ ID NO: 6415 - DNA, 31 bp, Artificial Sequence
  Description of Artificial Sequence:  Enzymatic Nucleic Acid
ctgggctgggctagctacaacgaaccatctc

SEQ ID NO: 6416 - DNA, 31 bp, Artificial Sequence
  Description of Artificial Sequence:  Enzymatic Nucleic Acid
ccactgggggctagctacaacgatgcaccat

SEQ ID NO: 6417 - DNA, 31 bp, Artificial Sequence
  Description of Artificial Sequence:  Enzymatic Nucleic Acid
ggccaccaggctagctacaacgatgggctgc

SEQ ID NO: 6418 - DNA, 31 bp, Artificial Sequence
  Description of Artificial Sequence:  Enzymatic Nucleic Acid
ccgggccaggctagctacaacgacactgggc

SEQ ID NO: 6419 - DNA, 31 bp, Artificial Sequence
  Description of Artificial Sequence:  Enzymatic Nucleic Acid
ctgccgggggctagctacaacgacaccactg

SEQ ID NO: 6420 - DNA, 31 bp, Artificial Sequence
  Description of Artificial Sequence:  Enzymatic Nucleic Acid
atctgctgggctagctacaacgacgggccac

SEQ ID NO: 6421 - DNA, 31 bp, Artificial Sequence
  Description of Artificial Sequence:  Enzymatic Nucleic Acid
ctgatctgggctagctacaacgatgccgggc

SEQ ID NO: 6422 - DNA, 31 bp, Artificial Sequence
  Description of Artificial Sequence:  Enzymatic Nucleic Acid
cgtcctgaggctagctacaacgactgctgcc

SEQ ID NO: 6423 - DNA, 31 bp, Artificial Sequence
  Description of Artificial Sequence:  Enzymatic Nucleic Acid
ccagtacgggctagctacaacgacctgatct

SEQ ID NO: 6424 - DNA, 31 bp, Artificial Sequence
  Description of Artificial Sequence:  Enzymatic Nucleic Acid
gcccagtaggctagctacaacgagtcctgat

SEQ ID NO: 6425 - DNA, 31 bp, Artificial Sequence
  Description of Artificial Sequence:  Enzymatic Nucleic Acid
tcgcccagggctagctacaacgaacgtcctg

SEQ ID NO: 6426 - DNA, 31 bp, Artificial Sequence
  Description of Artificial Sequence:  Enzymatic Nucleic Acid
actcttcgggctagctacaacgaccagtacg

SEQ ID NO: 6427 - DNA, 31 bp, Artificial Sequence
  Description of Artificial Sequence:  Enzymatic Nucleic Acid
agaggagaggctagctacaacgatcttcgcc

SEQ ID NO: 6428 - DNA, 31 bp, Artificial Sequence
  Description of Artificial Sequence:  Enzymatic Nucleic Acid
atggctggggctagctacaacgattccccag

SEQ ID NO: 6429 - DNA, 31 bp, Artificial Sequence
  Description of Artificial Sequence:  Enzymatic Nucleic Acid
cagcatggggctagctacaacgatggcttcc

SEQ ID NO: 6430 - DNA, 31 bp, Artificial Sequence
  Description of Artificial Sequence:  Enzymatic Nucleic Acid
gtgcagcaggctagctacaacgaggctggct

SEQ ID NO: 6431 - DNA, 31 bp, Artificial Sequence
  Description of Artificial Sequence:  Enzymatic Nucleic Acid
aggtgcagggctagctacaacgaatggctgg

SEQ ID NO: 6432 - DNA, 31 bp, Artificial Sequence
  Description of Artificial Sequence:  Enzymatic Nucleic Acid
ggcaggtgggctagctacaacgaagcatggc

SEQ ID NO: 6433 - DNA, 31 bp, Artificial Sequence
  Description of Artificial Sequence:  Enzymatic Nucleic Acid
aaggcaggggctagctacaacgagcagcatg

SEQ ID NO: 6434 - DNA, 31 bp, Artificial Sequence
  Description of Artificial Sequence:  Enzymatic Nucleic Acid
tctgaaggggctagctacaacgaaggtgcag

SEQ ID NO: 6435 - DNA, 31 bp, Artificial Sequence
  Description of Artificial Sequence:  Enzymatic Nucleic Acid
gcgccctgggctagctacaacgatctgaagg

SEQ ID NO: 6436 - DNA, 31 bp, Artificial Sequence
  Description of Artificial Sequence:  Enzymatic Nucleic Acid
caggagcgggctagctacaacgacctgttct

SEQ ID NO: 6437 - DNA, 31 bp, Artificial Sequence
  Description of Artificial Sequence:  Enzymatic Nucleic Acid
ctcaggagggctagctacaacgagccctgtt

SEQ ID NO: 6438 - DNA, 31 bp, Artificial Sequence
  Description of Artificial Sequence:  Enzymatic Nucleic Acid
ctggagggggctagctacaacgactcaggag

SEQ ID NO: 6439 - DNA, 31 bp, Artificial Sequence
  Description of Artificial Sequence:  Enzymatic Nucleic Acid
aggcagcgggctagctacaacgatggagggt

SEQ ID NO: 6440 - DNA, 31 bp, Artificial Sequence
  Description of Artificial Sequence:  Enzymatic Nucleic Acid
ccaggcagggctagctacaacgagctggagg

SEQ ID NO: 6441 - DNA, 31 bp, Artificial Sequence
  Description of Artificial Sequence:  Enzymatic Nucleic Acid
cctccaggggctagctacaacgaagcgctgg

SEQ ID NO: 6442 - DNA, 31 bp, Artificial Sequence
  Description of Artificial Sequence:  Enzymatic Nucleic Acid
gctcttgaggctagctacaacgatctcctcc

SEQ ID NO: 6443 - DNA, 31 bp, Artificial Sequence
  Description of Artificial Sequence:  Enzymatic Nucleic Acid
tctcggagggctagctacaacgatcttgatt

SEQ ID NO: 6444 - DNA, 31 bp, Artificial Sequence
  Description of Artificial Sequence:  Enzymatic Nucleic Acid
ggatggcaggctagctacaacgactcggagc

SEQ ID NO: 6445 - DNA, 31 bp, Artificial Sequence
  Description of Artificial Sequence:  Enzymatic Nucleic Acid
ccggatggggctagctacaacgaatctcgga

SEQ ID NO: 6446 - DNA, 31 bp, Artificial Sequence
  Description of Artificial Sequence:  Enzymatic Nucleic Acid
ctgccggaggctagctacaacgaggcatctc

SEQ ID NO: 6447 - DNA, 31 bp, Artificial Sequence
  Description of Artificial Sequence:  Enzymatic Nucleic Acid
ttgctctgggctagctacaacgacggatggc

SEQ ID NO: 6448 - DNA, 31 bp, Artificial Sequence
  Description of Artificial Sequence:  Enzymatic Nucleic Acid
tctggttgggctagctacaacgatctgccgg

SEQ ID NO: 6449 - DNA, 31 bp, Artificial Sequence
  Description of Artificial Sequence:  Enzymatic Nucleic Acid
gaatctggggctagctacaacgatgctctgc

SEQ ID NO: 6450 - DNA, 31 bp, Artificial Sequence
  Description of Artificial Sequence:  Enzymatic Nucleic Acid
ccgcagaaggctagctacaacgactggttgc

SEQ ID NO: 6451 - DNA, 31 bp, Artificial Sequence
  Description of Artificial Sequence:  Enzymatic Nucleic Acid
cgctcccgggctagctacaacgaagaatctg

SEQ ID NO: 6452 - DNA, 31 bp, Artificial Sequence
  Description of Artificial Sequence:  Enzymatic Nucleic Acid
tcgcagcgggctagctacaacgatcccgcag

SEQ ID NO: 6453 - DNA, 31 bp, Artificial Sequence
  Description of Artificial Sequence:  Enzymatic Nucleic Acid
cctcgcagggctagctacaacgagctcccgc

SEQ ID NO: 6454 - DNA, 31 bp, Artificial Sequence
  Description of Artificial Sequence:  Enzymatic Nucleic Acid
gctcctcgggctagctacaacgaagcgctcc

SEQ ID NO: 6455 - DNA, 31 bp, Artificial Sequence
  Description of Artificial Sequence:  Enzymatic Nucleic Acid
tgcagaagggctagctacaacgatcctcgca

SEQ ID NO: 6456 - DNA, 31 bp, Artificial Sequence
  Description of Artificial Sequence:  Enzymatic Nucleic Acid
tggaaatgggctagctacaacgaagaagctc

SEQ ID NO: 6457 - DNA, 31 bp, Artificial Sequence
  Description of Artificial Sequence:  Enzymatic Nucleic Acid
cttggaaaggctagctacaacgagcagaagc

SEQ ID NO: 6458 - DNA, 31 bp, Artificial Sequence
  Description of Artificial Sequence:  Enzymatic Nucleic Acid
ctggctggggctagctacaacgattggaaat

SEQ ID NO: 6459 - DNA, 31 bp, Artificial Sequence
  Description of Artificial Sequence:  Enzymatic Nucleic Acid
ccctctggggctagctacaacgatggcttgg

SEQ ID NO: 6460 - DNA, 31 bp, Artificial Sequence
  Description of Artificial Sequence:  Enzymatic Nucleic Acid
atgaggaaggctagctacaacgatccttctc

SEQ ID NO: 6461 - DNA, 31 bp, Artificial Sequence
  Description of Artificial Sequence:  Enzymatic Nucleic Acid
cttgcacaggctagctacaacgagaggaact

SEQ ID NO: 6462 - DNA, 31 bp, Artificial Sequence
  Description of Artificial Sequence:  Enzymatic Nucleic Acid
aacttgcaggctagctacaacgaatgaggaa

SEQ ID NO: 6463 - DNA, 31 bp, Artificial Sequence
  Description of Artificial Sequence:  Enzymatic Nucleic Acid
ggaacttgggctagctacaacgaacatgagg

SEQ ID NO: 6464 - DNA, 31 bp, Artificial Sequence
  Description of Artificial Sequence:  Enzymatic Nucleic Acid
tcctggaaggctagctacaacgattgcacat

SEQ ID NO: 6465 - DNA, 31 bp, Artificial Sequence
  Description of Artificial Sequence:  Enzymatic Nucleic Acid
tttcctggggctagctacaacgactcctgga

SEQ ID NO: 6466 - DNA, 31 bp, Artificial Sequence
  Description of Artificial Sequence:  Enzymatic Nucleic Acid
tccaccagggctagctacaacgattcctggc

SEQ ID NO: 6467 - DNA, 31 bp, Artificial Sequence
  Description of Artificial Sequence:  Enzymatic Nucleic Acid
tctctccaggctagctacaacgacagtttcc

SEQ ID NO: 6468 - DNA, 31 bp, Artificial Sequence
  Description of Artificial Sequence:  Enzymatic Nucleic Acid
aggccgagggctagctacaacgactctccac

SEQ ID NO: 6469 - DNA, 31 bp, Artificial Sequence
  Description of Artificial Sequence:  Enzymatic Nucleic Acid
tctccaggggctagctacaacgacgagtctc

SEQ ID NO: 6470 - DNA, 31 bp, Artificial Sequence
  Description of Artificial Sequence:  Enzymatic Nucleic Acid
agatcgagggctagctacaacgattctccag

SEQ ID NO: 6471 - DNA, 31 bp, Artificial Sequence
  Description of Artificial Sequence:  Enzymatic Nucleic Acid
tcttcagaggctagctacaacgacgagcttc

SEQ ID NO: 6472 - DNA, 31 bp, Artificial Sequence
  Description of Artificial Sequence:  Enzymatic Nucleic Acid
tccttctgggctagctacaacgactcttcag

SEQ ID NO: 6473 - DNA, 31 bp, Artificial Sequence
  Description of Artificial Sequence:  Enzymatic Nucleic Acid
agagcctgggctagctacaacgatccttctg

SEQ ID NO: 6474 - DNA, 31 bp, Artificial Sequence
  Description of Artificial Sequence:  Enzymatic Nucleic Acid
ccgcagagggctagctacaacgactgctcct

SEQ ID NO: 6475 - DNA, 31 bp, Artificial Sequence
  Description of Artificial Sequence:  Enzymatic Nucleic Acid
acctcccgggctagctacaacgaagagcctg

SEQ ID NO: 6476 - DNA, 31 bp, Artificial Sequence
  Description of Artificial Sequence:  Enzymatic Nucleic Acid
gtgctccaggctagctacaacgactcccgca

SEQ ID NO: 6477 - DNA, 31 bp, Artificial Sequence
  Description of Artificial Sequence:  Enzymatic Nucleic Acid
ttcaggtgggctagctacaacgatccacctc

SEQ ID NO: 6478 - DNA, 31 bp, Artificial Sequence
  Description of Artificial Sequence:  Enzymatic Nucleic Acid
tcttcaggggctagctacaacgagctccacc

SEQ ID NO: 6479 - DNA, 31 bp, Artificial Sequence
  Description of Artificial Sequence:  Enzymatic Nucleic Acid
tgctggcaggctagctacaacgactcttcag

SEQ ID NO: 6480 - DNA, 31 bp, Artificial Sequence
  Description of Artificial Sequence:  Enzymatic Nucleic Acid
gctgctggggctagctacaacgaatctcttc

SEQ ID NO: 6481 - DNA, 31 bp, Artificial Sequence
  Description of Artificial Sequence:  Enzymatic Nucleic Acid
atctgctgggctagctacaacgatggcatct

SEQ ID NO: 6482 - DNA, 31 bp, Artificial Sequence
  Description of Artificial Sequence:  Enzymatic Nucleic Acid
gccatctgggctagctacaacgatgctggca

SEQ ID NO: 6483 - DNA, 31 bp, Artificial Sequence
  Description of Artificial Sequence:  Enzymatic Nucleic Acid
ctcagccaggctagctacaacgactgctgct

SEQ ID NO: 6484 - DNA, 31 bp, Artificial Sequence
  Description of Artificial Sequence:  Enzymatic Nucleic Acid
gtcctcagggctagctacaacgacatctgct

SEQ ID NO: 6485 - DNA, 31 bp, Artificial Sequence
  Description of Artificial Sequence:  Enzymatic Nucleic Acid
aggccttgggctagctacaacgacctcagcc

SEQ ID NO: 6486 - DNA, 31 bp, Artificial Sequence
  Description of Artificial Sequence:  Enzymatic Nucleic Acid
cacagaggggctagctacaacgacttgtcct

SEQ ID NO: 6487 - DNA, 31 bp, Artificial Sequence
  Description of Artificial Sequence:  Enzymatic Nucleic Acid
ggctttcaggctagctacaacgaagaggcct

SEQ ID NO: 6488 - DNA, 31 bp, Artificial Sequence
  Description of Artificial Sequence:  Enzymatic Nucleic Acid
cacctgggggctagctacaacgatttcacag

SEQ ID NO: 6489 - DNA, 31 bp, Artificial Sequence
  Description of Artificial Sequence:  Enzymatic Nucleic Acid
ggacgtcaggctagctacaacgactgggctt

SEQ ID NO: 6490 - DNA, 31 bp, Artificial Sequence
  Description of Artificial Sequence:  Enzymatic Nucleic Acid
caaggacgggctagctacaacgacacctggg

SEQ ID NO: 6491 - DNA, 31 bp, Artificial Sequence
  Description of Artificial Sequence:  Enzymatic Nucleic Acid
agcaaggaggctagctacaacgagtcacctg

SEQ ID NO: 6492 - DNA, 31 bp, Artificial Sequence
  Description of Artificial Sequence:  Enzymatic Nucleic Acid
tccccgagggctagctacaacgaaaggacgt

SEQ ID NO: 6493 - DNA, 31 bp, Artificial Sequence
  Description of Artificial Sequence:  Enzymatic Nucleic Acid
tcctgcagggctagctacaacgatccccgag

SEQ ID NO: 6494 - DNA, 31 bp, Artificial Sequence
  Description of Artificial Sequence:  Enzymatic Nucleic Acid
ctctcctgggctagctacaacgaagctcccc

SEQ ID NO: 6495 - DNA, 31 bp, Artificial Sequence
  Description of Artificial Sequence:  Enzymatic Nucleic Acid
gactctggggctagctacaacgatctcctgc

SEQ ID NO: 6496 - DNA, 31 bp, Artificial Sequence
  Description of Artificial Sequence:  Enzymatic Nucleic Acid
ccaagcgaggctagctacaacgatctggctc

SEQ ID NO: 6497 - DNA, 31 bp, Artificial Sequence
  Description of Artificial Sequence:  Enzymatic Nucleic Acid
cctccaagggctagctacaacgagactctgg

SEQ ID NO: 6498 - DNA, 31 bp, Artificial Sequence
  Description of Artificial Sequence:  Enzymatic Nucleic Acid
agtggcagggctagctacaacgactccaagc

SEQ ID NO: 6499 - DNA, 31 bp, Artificial Sequence
  Description of Artificial Sequence:  Enzymatic Nucleic Acid
cttagtggggctagctacaacgaagcctcca

SEQ ID NO: 6500 - DNA, 31 bp, Artificial Sequence
  Description of Artificial Sequence:  Enzymatic Nucleic Acid
ttccttagggctagctacaacgaggcagcct

SEQ ID NO: 6501 - DNA, 31 bp, Artificial Sequence
  Description of Artificial Sequence:  Enzymatic Nucleic Acid
gcctggcaggctagctacaacgatccttagt

SEQ ID NO: 6502 - DNA, 31 bp, Artificial Sequence
  Description of Artificial Sequence:  Enzymatic Nucleic Acid
gagcctggggctagctacaacgaattcctta

SEQ ID NO: 6503 - DNA, 31 bp, Artificial Sequence
  Description of Artificial Sequence:  Enzymatic Nucleic Acid
ctccagagggctagctacaacgactggcatt

SEQ ID NO: 6504 - DNA, 31 bp, Artificial Sequence
  Description of Artificial Sequence:  Enzymatic Nucleic Acid
gggcccgaggctagctacaacgacctccaga

SEQ ID NO: 6505 - DNA, 31 bp, Artificial Sequence
  Description of Artificial Sequence:  Enzymatic Nucleic Acid
cgcccgggggctagctacaacgaccgaccct

SEQ ID NO: 6506 - DNA, 31 bp, Artificial Sequence
  Description of Artificial Sequence:  Enzymatic Nucleic Acid
gctggccgggctagctacaacgaccgggccc

SEQ ID NO: 6507 - DNA, 31 bp, Artificial Sequence
  Description of Artificial Sequence:  Enzymatic Nucleic Acid
ctcgctggggctagctacaacgacgcccggg

SEQ ID NO: 6508 - DNA, 31 bp, Artificial Sequence
  Description of Artificial Sequence:  Enzymatic Nucleic Acid
cctgctcgggctagctacaacgatggccgcc

SEQ ID NO: 6509 - DNA, 31 bp, Artificial Sequence
  Description of Artificial Sequence:  Enzymatic Nucleic Acid
cgcgcctgggctagctacaacgatcgctggc

SEQ ID NO: 6510 - DNA, 31 bp, Artificial Sequence
  Description of Artificial Sequence:  Enzymatic Nucleic Acid
ctgccgcgggctagctacaacgactgctcgc

SEQ ID NO: 6511 - DNA, 31 bp, Artificial Sequence
  Description of Artificial Sequence:  Enzymatic Nucleic Acid
agctgccgggctagctacaacgagcctgctc

SEQ ID NO: 6512 - DNA, 31 bp, Artificial Sequence
  Description of Artificial Sequence:  Enzymatic Nucleic Acid
tccagctgggctagctacaacgacgcgcctg

SEQ ID NO: 6513 - DNA, 31 bp, Artificial Sequence
  Description of Artificial Sequence:  Enzymatic Nucleic Acid
ctctccagggctagctacaacgatgccgcgc

SEQ ID NO: 6514 - DNA, 31 bp, Artificial Sequence
  Description of Artificial Sequence:  Enzymatic Nucleic Acid
cgcgctcaggctagctacaacgatctccagc

SEQ ID NO: 6515 - DNA, 31 bp, Artificial Sequence
  Description of Artificial Sequence:  Enzymatic Nucleic Acid
gcctcgcgggctagctacaacgatcactctc

SEQ ID NO: 6516 - DNA, 31 bp, Artificial Sequence
  Description of Artificial Sequence:  Enzymatic Nucleic Acid
gcgcctcgggctagctacaacgagctcactc

SEQ ID NO: 6517 - DNA, 31 bp, Artificial Sequence
  Description of Artificial Sequence:  Enzymatic Nucleic Acid
ctgcagcgggctagctacaacgactcgcgct

SEQ ID NO: 6518 - DNA, 31 bp, Artificial Sequence
  Description of Artificial Sequence:  Enzymatic Nucleic Acid
tgctgcagggctagctacaacgagcctcgcg

SEQ ID NO: 6519 - DNA, 31 bp, Artificial Sequence
  Description of Artificial Sequence:  Enzymatic Nucleic Acid
tgctgctgggctagctacaacgaagcgcctc

SEQ ID NO: 6520 - DNA, 31 bp, Artificial Sequence
  Description of Artificial Sequence:  Enzymatic Nucleic Acid
tgctgctgggctagctacaacgatgcagcgc

SEQ ID NO: 6521 - DNA, 31 bp, Artificial Sequence
  Description of Artificial Sequence:  Enzymatic Nucleic Acid
ctgtgctgggctagctacaacgatgctgcag

SEQ ID NO: 6522 - DNA, 31 bp, Artificial Sequence
  Description of Artificial Sequence:  Enzymatic Nucleic Acid
acgctgtgggctagctacaacgatgctgctg

SEQ ID NO: 6523 - DNA, 31 bp, Artificial Sequence
  Description of Artificial Sequence:  Enzymatic Nucleic Acid
gcacgctgggctagctacaacgagctgctgc

SEQ ID NO: 6524 - DNA, 31 bp, Artificial Sequence
  Description of Artificial Sequence:  Enzymatic Nucleic Acid
cctgcacgggctagctacaacgatgtgctgc

SEQ ID NO: 6525 - DNA, 31 bp, Artificial Sequence
  Description of Artificial Sequence:  Enzymatic Nucleic Acid
cacctgcaggctagctacaacgagctgtgct

SEQ ID NO: 6526 - DNA, 31 bp, Artificial Sequence
  Description of Artificial Sequence:  Enzymatic Nucleic Acid
tccacctgggctagctacaacgaacgctgtg

SEQ ID NO: 6527 - DNA, 31 bp, Artificial Sequence
  Description of Artificial Sequence:  Enzymatic Nucleic Acid
ctggtccaggctagctacaacgactgcacgc

SEQ ID NO: 6528 - DNA, 31 bp, Artificial Sequence
  Description of Artificial Sequence:  Enzymatic Nucleic Acid
gcagctggggctagctacaacgaccacctgc

SEQ ID NO: 6529 - DNA, 31 bp, Artificial Sequence
  Description of Artificial Sequence:  Enzymatic Nucleic Acid
atgcgcagggctagctacaacgatggtccac

SEQ ID NO: 6530 - DNA, 31 bp, Artificial Sequence
  Description of Artificial Sequence:  Enzymatic Nucleic Acid
tgcatgcgggctagctacaacgaagctggtc

SEQ ID NO: 6531 - DNA, 31 bp, Artificial Sequence
  Description of Artificial Sequence:  Enzymatic Nucleic Acid
cctgcatgggctagctacaacgagcagctgg

SEQ ID NO: 6532 - DNA, 31 bp, Artificial Sequence
  Description of Artificial Sequence:  Enzymatic Nucleic Acid
gccctgcaggctagctacaacgagcgcagct

SEQ ID NO: 6533 - DNA, 31 bp, Artificial Sequence
  Description of Artificial Sequence:  Enzymatic Nucleic Acid
tggccctgggctagctacaacgaatgcgcag

SEQ ID NO: 6534 - DNA, 31 bp, Artificial Sequence
  Description of Artificial Sequence:  Enzymatic Nucleic Acid
cgctctggggctagctacaacgacctgcatg

SEQ ID NO: 6535 - DNA, 31 bp, Artificial Sequence
  Description of Artificial Sequence:  Enzymatic Nucleic Acid
cctccacgggctagctacaacgatctggccc

SEQ ID NO: 6536 - DNA, 31 bp, Artificial Sequence
  Description of Artificial Sequence:  Enzymatic Nucleic Acid
ggcctccaggctagctacaacgagctctggc

SEQ ID NO: 6537 - DNA, 31 bp, Artificial Sequence
  Description of Artificial Sequence:  Enzymatic Nucleic Acid
gagcgcggggctagctacaacgactccacgc

SEQ ID NO: 6538 - DNA, 31 bp, Artificial Sequence
  Description of Artificial Sequence:  Enzymatic Nucleic Acid
gcggagcgggctagctacaacgaggcctcca

SEQ ID NO: 6539 - DNA, 31 bp, Artificial Sequence
  Description of Artificial Sequence:  Enzymatic Nucleic Acid
atgcggagggctagctacaacgagcggcctc

SEQ ID NO: 6540 - DNA, 31 bp, Artificial Sequence
  Description of Artificial Sequence:  Enzymatic Nucleic Acid
gctccatgggctagctacaacgaggagcgcg

SEQ ID NO: 6541 - DNA, 31 bp, Artificial Sequence
  Description of Artificial Sequence:  Enzymatic Nucleic Acid
gcgctccaggctagctacaacgagcggagcg

SEQ ID NO: 6542 - DNA, 31 bp, Artificial Sequence
  Description of Artificial Sequence:  Enzymatic Nucleic Acid
gcctggcgggctagctacaacgatccatgcg

SEQ ID NO: 6543 - DNA, 31 bp, Artificial Sequence
  Description of Artificial Sequence:  Enzymatic Nucleic Acid
cggcctggggctagctacaacgagctccatg

SEQ ID NO: 6544 - DNA, 31 bp, Artificial Sequence
  Description of Artificial Sequence:  Enzymatic Nucleic Acid
cgaggcggggctagctacaacgactggcgct

SEQ ID NO: 6545 - DNA, 31 bp, Artificial Sequence
  Description of Artificial Sequence:  Enzymatic Nucleic Acid
ctccgaggggctagctacaacgaggcctggc

SEQ ID NO: 6546 - DNA, 31 bp, Artificial Sequence
  Description of Artificial Sequence:  Enzymatic Nucleic Acid
tgggccagggctagctacaacgattcctctt

SEQ ID NO: 6547 - DNA, 31 bp, Artificial Sequence
  Description of Artificial Sequence:  Enzymatic Nucleic Acid
caactgggggctagctacaacgacagcttcc

SEQ ID NO: 6548 - DNA, 31 bp, Artificial Sequence
  Description of Artificial Sequence:  Enzymatic Nucleic Acid
acctgcaaggctagctacaacgatgggccag

SEQ ID NO: 6549 - DNA, 31 bp, Artificial Sequence
  Description of Artificial Sequence:  Enzymatic Nucleic Acid
gccacctgggctagctacaacgaaactgggc

SEQ ID NO: 6550 - DNA, 31 bp, Artificial Sequence
  Description of Artificial Sequence:  Enzymatic Nucleic Acid
ataggccaggctagctacaacgactgcaact

SEQ ID NO: 6551 - DNA, 31 bp, Artificial Sequence
  Description of Artificial Sequence:  Enzymatic Nucleic Acid
gtgataggggctagctacaacgacacctgca

SEQ ID NO: 6552 - DNA, 31 bp, Artificial Sequence
  Description of Artificial Sequence:  Enzymatic Nucleic Acid
gctggtgaggctagctacaacgaaggccacc

SEQ ID NO: 6553 - DNA, 31 bp, Artificial Sequence
  Description of Artificial Sequence:  Enzymatic Nucleic Acid
agagctggggctagctacaacgagataggcc

SEQ ID NO: 6554 - DNA, 31 bp, Artificial Sequence
  Description of Artificial Sequence:  Enzymatic Nucleic Acid
tggaagagggctagctacaacgatggtgata

SEQ ID NO: 6555 - DNA, 31 bp, Artificial Sequence
  Description of Artificial Sequence:  Enzymatic Nucleic Acid
ttgtcgtaggctagctacaacgatcttggaa

SEQ ID NO: 6556 - DNA, 31 bp, Artificial Sequence
  Description of Artificial Sequence:  Enzymatic Nucleic Acid
ggttgtcgggctagctacaacgaattcttgg

SEQ ID NO: 6557 - DNA, 31 bp, Artificial Sequence
  Description of Artificial Sequence:  Enzymatic Nucleic Acid
tgtggttgggctagctacaacgacgtattct

SEQ ID NO: 6558 - DNA, 31 bp, Artificial Sequence
  Description of Artificial Sequence:  Enzymatic Nucleic Acid
tgatgtggggctagctacaacgatgtcgtat

SEQ ID NO: 6559 - DNA, 31 bp, Artificial Sequence
  Description of Artificial Sequence:  Enzymatic Nucleic Acid
tcttgatgggctagctacaacgaggttgtcg

SEQ ID NO: 6560 - DNA, 31 bp, Artificial Sequence
  Description of Artificial Sequence:  Enzymatic Nucleic Acid
gctcttgaggctagctacaacgagtggttgt

SEQ ID NO: 6561 - DNA, 31 bp, Artificial Sequence
  Description of Artificial Sequence:  Enzymatic Nucleic Acid
ccacgctgggctagctacaacgatcttgatg

SEQ ID NO: 6562 - DNA, 31 bp, Artificial Sequence
  Description of Artificial Sequence:  Enzymatic Nucleic Acid
ccaccacgggctagctacaacgatgctcttg

SEQ ID NO: 6563 - DNA, 31 bp, Artificial Sequence
  Description of Artificial Sequence:  Enzymatic Nucleic Acid
gcccaccaggctagctacaacgagctgctct

SEQ ID NO: 6564 - DNA, 31 bp, Artificial Sequence
  Description of Artificial Sequence:  Enzymatic Nucleic Acid
actgcccaggctagctacaacgacacgctgc

SEQ ID NO: 6565 - DNA, 31 bp, Artificial Sequence
  Description of Artificial Sequence:  Enzymatic Nucleic Acid
gctcactgggctagctacaacgaccaccacg

SEQ ID NO: 6566 - DNA, 31 bp, Artificial Sequence
  Description of Artificial Sequence:  Enzymatic Nucleic Acid
tccgctcaggctagctacaacgatgcccacc

SEQ ID NO: 6567 - DNA, 31 bp, Artificial Sequence
  Description of Artificial Sequence:  Enzymatic Nucleic Acid
cgcttccgggctagctacaacgatcactgcc

SEQ ID NO: 6568 - DNA, 31 bp, Artificial Sequence
  Description of Artificial Sequence:  Enzymatic Nucleic Acid
attcctcgggctagctacaacgattccgctc

SEQ ID NO: 6569 - DNA, 31 bp, Artificial Sequence
  Description of Artificial Sequence:  Enzymatic Nucleic Acid
cagctgcaggctagctacaacgatcctcgct

SEQ ID NO: 6570 - DNA, 31 bp, Artificial Sequence
  Description of Artificial Sequence:  Enzymatic Nucleic Acid
tccagctgggctagctacaacgaattcctcg

SEQ ID NO: 6571 - DNA, 31 bp, Artificial Sequence
  Description of Artificial Sequence:  Enzymatic Nucleic Acid
tcttccagggctagctacaacgatgcattcc

SEQ ID NO: 6572 - DNA, 31 bp, Artificial Sequence
  Description of Artificial Sequence:  Enzymatic Nucleic Acid
gtttgagaggctagctacaacgacttccagc

SEQ ID NO: 6573 - DNA, 31 bp, Artificial Sequence
  Description of Artificial Sequence:  Enzymatic Nucleic Acid
agctgctgggctagctacaacgattgagatc

SEQ ID NO: 6574 - DNA, 31 bp, Artificial Sequence
  Description of Artificial Sequence:  Enzymatic Nucleic Acid
tggagctgggctagctacaacgatgtttgag

SEQ ID NO: 6575 - DNA, 31 bp, Artificial Sequence
  Description of Artificial Sequence:  Enzymatic Nucleic Acid
tgctggagggctagctacaacgatgctgttt

SEQ ID NO: 6576 - DNA, 31 bp, Artificial Sequence
  Description of Artificial Sequence:  Enzymatic Nucleic Acid
tcggcctgggctagctacaacgatggagctg

SEQ ID NO: 6577 - DNA, 31 bp, Artificial Sequence
  Description of Artificial Sequence:  Enzymatic Nucleic Acid
ctcctcggggctagctacaacgactgctgga

SEQ ID NO: 6578 - DNA, 31 bp, Artificial Sequence
  Description of Artificial Sequence:  Enzymatic Nucleic Acid
caccagggggctagctacaacgactcctcgg

SEQ ID NO: 6579 - DNA, 31 bp, Artificial Sequence
  Description of Artificial Sequence:  Enzymatic Nucleic Acid
tttggccaggctagctacaacgacagggcct

SEQ ID NO: 6580 - DNA, 31 bp, Artificial Sequence
  Description of Artificial Sequence:  Enzymatic Nucleic Acid
ctgtttggggctagctacaacgacaccaggg

SEQ ID NO: 6581 - DNA, 31 bp, Artificial Sequence
  Description of Artificial Sequence:  Enzymatic Nucleic Acid
acctcctgggctagctacaacgattggccac

SEQ ID NO: 6582 - DNA, 31 bp, Artificial Sequence
  Description of Artificial Sequence:  Enzymatic Nucleic Acid
atcgatcaggctagctacaacgactcctgtt

SEQ ID NO: 6583 - DNA, 31 bp, Artificial Sequence
  Description of Artificial Sequence:  Enzymatic Nucleic Acid
cttatcgaggctagctacaacgacacctcct

SEQ ID NO: 6584 - DNA, 31 bp, Artificial Sequence
  Description of Artificial Sequence:  Enzymatic Nucleic Acid
tcagcttaggctagctacaacgacgatcacc

SEQ ID NO: 6585 - DNA, 31 bp, Artificial Sequence
  Description of Artificial Sequence:  Enzymatic Nucleic Acid
tccttcagggctagctacaacgattatcgat

SEQ ID NO: 6586 - DNA, 31 bp, Artificial Sequence
  Description of Artificial Sequence:  Enzymatic Nucleic Acid
ctgctcggggctagctacaacgactcctcct

SEQ ID NO: 6587 - DNA, 31 bp, Artificial Sequence
  Description of Artificial Sequence:  Enzymatic Nucleic Acid
ttgtgctgggctagctacaacgatcggcctc

SEQ ID NO: 6588 - DNA, 31 bp, Artificial Sequence
  Description of Artificial Sequence:  Enzymatic Nucleic Acid
atcttgtgggctagctacaacgatgctcggc

SEQ ID NO: 6589 - DNA, 31 bp, Artificial Sequence
  Description of Artificial Sequence:  Enzymatic Nucleic Acid
caatcttgggctagctacaacgagctgctcg

SEQ ID NO: 6590 - DNA, 31 bp, Artificial Sequence
  Description of Artificial Sequence:  Enzymatic Nucleic Acid
catcacaaggctagctacaacgacttgtgct

SEQ ID NO: 6591 - DNA, 31 bp, Artificial Sequence
  Description of Artificial Sequence:  Enzymatic Nucleic Acid
ctccatcaggctagctacaacgaaatcttgt

SEQ ID NO: 6592 - DNA, 31 bp, Artificial Sequence
  Description of Artificial Sequence:  Enzymatic Nucleic Acid
ggtctccaggctagctacaacgacacaatct

SEQ ID NO: 6593 - DNA, 31 bp, Artificial Sequence
  Description of Artificial Sequence:  Enzymatic Nucleic Acid
cggaacggggctagctacaacgactccatca

SEQ ID NO: 6594 - DNA, 31 bp, Artificial Sequence
  Description of Artificial Sequence:  Enzymatic Nucleic Acid
caccggaaggctagctacaacgaggtctcca

SEQ ID NO: 6595 - DNA, 31 bp, Artificial Sequence
  Description of Artificial Sequence:  Enzymatic Nucleic Acid
cttcagcaggctagctacaacgacggaacgg

SEQ ID NO: 6596 - DNA, 31 bp, Artificial Sequence
  Description of Artificial Sequence:  Enzymatic Nucleic Acid
gccttcagggctagctacaacgaaccggaac

SEQ ID NO: 6597 - DNA, 31 bp, Artificial Sequence
  Description of Artificial Sequence:  Enzymatic Nucleic Acid
cgcctgggggctagctacaacgacttcagca

SEQ ID NO: 6598 - DNA, 31 bp, Artificial Sequence
  Description of Artificial Sequence:  Enzymatic Nucleic Acid
gatatccgggctagctacaacgactgggcct

SEQ ID NO: 6599 - DNA, 31 bp, Artificial Sequence
  Description of Artificial Sequence:  Enzymatic Nucleic Acid
tgtagataggctagctacaacgaccgcctgg

SEQ ID NO: 6600 - DNA, 31 bp, Artificial Sequence
  Description of Artificial Sequence:  Enzymatic Nucleic Acid
cttgtagaggctagctacaacgaatccgcct

SEQ ID NO: 6601 - DNA, 31 bp, Artificial Sequence
  Description of Artificial Sequence:  Enzymatic Nucleic Acid
ccgccttgggctagctacaacgaagatatcc

SEQ ID NO: 6602 - DNA, 31 bp, Artificial Sequence
  Description of Artificial Sequence:  Enzymatic Nucleic Acid
gaagtccgggctagctacaacgacttgtaga

SEQ ID NO: 6603 - DNA, 31 bp, Artificial Sequence
  Description of Artificial Sequence:  Enzymatic Nucleic Acid
cctggaagggctagctacaacgaccgccttg

SEQ ID NO: 6604 - DNA, 31 bp, Artificial Sequence
  Description of Artificial Sequence:  Enzymatic Nucleic Acid
cctctcagggctagctacaacgactggaagt

SEQ ID NO: 6605 - DNA, 31 bp, Artificial Sequence
  Description of Artificial Sequence:  Enzymatic Nucleic Acid
cgggcctgggctagctacaacgactctcagc

SEQ ID NO: 6606 - DNA, 31 bp, Artificial Sequence
  Description of Artificial Sequence:  Enzymatic Nucleic Acid
ctcccgggggctagctacaacgactgcctct

SEQ ID NO: 6607 - DNA, 31 bp, Artificial Sequence
  Description of Artificial Sequence:  Enzymatic Nucleic Acid
tcggccagggctagctacaacgattctcccg

SEQ ID NO: 6608 - DNA, 31 bp, Artificial Sequence
  Description of Artificial Sequence:  Enzymatic Nucleic Acid
cttctcggggctagctacaacgacagcttct

SEQ ID NO: 6609 - DNA, 31 bp, Artificial Sequence
  Description of Artificial Sequence:  Enzymatic Nucleic Acid
tgcaggagggctagctacaacgatccttctt

SEQ ID NO: 6610 - DNA, 31 bp, Artificial Sequence
  Description of Artificial Sequence:  Enzymatic Nucleic Acid
tgctcctgggctagctacaacgaaggagctc

SEQ ID NO: 6611 - DNA, 31 bp, Artificial Sequence
  Description of Artificial Sequence:  Enzymatic Nucleic Acid
tccagctgggctagctacaacgatcctgcag

SEQ ID NO: 6612 - DNA, 31 bp, Artificial Sequence
  Description of Artificial Sequence:  Enzymatic Nucleic Acid
tgctccagggctagctacaacgatgctcctg

SEQ ID NO: 6613 - DNA, 31 bp, Artificial Sequence
  Description of Artificial Sequence:  Enzymatic Nucleic Acid
tgcagctgggctagctacaacgatccagctg

SEQ ID NO: 6614 - DNA, 31 bp, Artificial Sequence
  Description of Artificial Sequence:  Enzymatic Nucleic Acid
ctctgcagggctagctacaacgatgctccag

SEQ ID NO: 6615 - DNA, 31 bp, Artificial Sequence
  Description of Artificial Sequence:  Enzymatic Nucleic Acid
tccctctgggctagctacaacgaagctgctc

SEQ ID NO: 6616 - DNA, 31 bp, Artificial Sequence
  Description of Artificial Sequence:  Enzymatic Nucleic Acid
ttgctgtaggctagctacaacgatccctctg

SEQ ID NO: 6617 - DNA, 31 bp, Artificial Sequence
  Description of Artificial Sequence:  Enzymatic Nucleic Acid
gtttgctgggctagctacaacgaactccctc

SEQ ID NO: 6618 - DNA, 31 bp, Artificial Sequence
  Description of Artificial Sequence:  Enzymatic Nucleic Acid
tcagtttgggctagctacaacgatgtactcc

SEQ ID NO: 6619 - DNA, 31 bp, Artificial Sequence
  Description of Artificial Sequence:  Enzymatic Nucleic Acid
gccttcagggctagctacaacgattgctgta

SEQ ID NO: 6620 - DNA, 31 bp, Artificial Sequence
  Description of Artificial Sequence:  Enzymatic Nucleic Acid
acagctggggctagctacaacgacttcagtt

SEQ ID NO: 6621 - DNA, 31 bp, Artificial Sequence
  Description of Artificial Sequence:  Enzymatic Nucleic Acid
cctgacagggctagctacaacgatggccttc

SEQ ID NO: 6622 - DNA, 31 bp, Artificial Sequence
  Description of Artificial Sequence:  Enzymatic Nucleic Acid
actcctgaggctagctacaacgaagctggcc

SEQ ID NO: 6623 - DNA, 31 bp, Artificial Sequence
  Description of Artificial Sequence:  Enzymatic Nucleic Acid
ctggccgaggctagctacaacgatcctgaca

SEQ ID NO: 6624 - DNA, 31 bp, Artificial Sequence
  Description of Artificial Sequence:  Enzymatic Nucleic Acid
gatcctggggctagctacaacgacgactcct

SEQ ID NO: 6625 - DNA, 31 bp, Artificial Sequence
  Description of Artificial Sequence:  Enzymatic Nucleic Acid
gtcctcgaggctagctacaacgacctggccg

SEQ ID NO: 6626 - DNA, 31 bp, Artificial Sequence
  Description of Artificial Sequence:  Enzymatic Nucleic Acid
tcctcatgggctagctacaacgacctcgatc

SEQ ID NO: 6627 - DNA, 31 bp, Artificial Sequence
  Description of Artificial Sequence:  Enzymatic Nucleic Acid
cttcctcaggctagctacaacgagtcctcga

SEQ ID NO: 6628 - DNA, 31 bp, Artificial Sequence
  Description of Artificial Sequence:  Enzymatic Nucleic Acid
acatgccgggctagctacaacgattcctcat

SEQ ID NO: 6629 - DNA, 31 bp, Artificial Sequence
  Description of Artificial Sequence:  Enzymatic Nucleic Acid
tcgacatgggctagctacaacgacgcttcct

SEQ ID NO: 6630 - DNA, 31 bp, Artificial Sequence
  Description of Artificial Sequence:  Enzymatic Nucleic Acid
cctcgacaggctagctacaacgagccgcttc

SEQ ID NO: 6631 - DNA, 31 bp, Artificial Sequence
  Description of Artificial Sequence:  Enzymatic Nucleic Acid
gacctcgaggctagctacaacgaatgccgct

SEQ ID NO: 6632 - DNA, 31 bp, Artificial Sequence
  Description of Artificial Sequence:  Enzymatic Nucleic Acid
ctgggagaggctagctacaacgactcgacat

SEQ ID NO: 6633 - DNA, 31 bp, Artificial Sequence
  Description of Artificial Sequence:  Enzymatic Nucleic Acid
caagggggggctagctacaacgactgggaga

SEQ ID NO: 6634 - DNA, 31 bp, Artificial Sequence
  Description of Artificial Sequence:  Enzymatic Nucleic Acid
gcggggggggctagctacaacgaaagggggc

SEQ ID NO: 6635 - DNA, 31 bp, Artificial Sequence
  Description of Artificial Sequence:  Enzymatic Nucleic Acid
ggcaggggggctagctacaacgaggggggca

SEQ ID NO: 6636 - DNA, 31 bp, Artificial Sequence
  Description of Artificial Sequence:  Enzymatic Nucleic Acid
gaggtaggggctagctacaacgaaggggcgg

SEQ ID NO: 6637 - DNA, 31 bp, Artificial Sequence
  Description of Artificial Sequence:  Enzymatic Nucleic Acid
aggagaggggctagctacaacgaaggcaggg

SEQ ID NO: 6638 - DNA, 31 bp, Artificial Sequence
  Description of Artificial Sequence:  Enzymatic Nucleic Acid
gggcagggggctagctacaacgacaggggag

SEQ ID NO: 6639 - DNA, 31 bp, Artificial Sequence
  Description of Artificial Sequence:  Enzymatic Nucleic Acid
tggctgggggctagctacaacgaagggccag

SEQ ID NO: 6640 - DNA, 31 bp, Artificial Sequence
  Description of Artificial Sequence:  Enzymatic Nucleic Acid
tcctctggggctagctacaacgatgggcagg

SEQ ID NO: 6641 - DNA, 31 bp, Artificial Sequence
  Description of Artificial Sequence:  Enzymatic Nucleic Acid
cgggggggggctagctacaacgatcctcctc

SEQ ID NO: 6642 - DNA, 31 bp, Artificial Sequence
  Description of Artificial Sequence:  Enzymatic Nucleic Acid
tcaggtggggctagctacaacgatcctcggg

SEQ ID NO: 6643 - DNA, 31 bp, Artificial Sequence
  Description of Artificial Sequence:  Enzymatic Nucleic Acid
aagtcaggggctagctacaacgaggctcctc

SEQ ID NO: 6644 - DNA, 31 bp, Artificial Sequence
  Description of Artificial Sequence:  Enzymatic Nucleic Acid
agcagaagggctagctacaacgacaggtggc

SEQ ID NO: 6645 - DNA, 31 bp, Artificial Sequence
  Description of Artificial Sequence:  Enzymatic Nucleic Acid
tgggacagggctagctacaacgaagaagtca

SEQ ID NO: 6646 - DNA, 31 bp, Artificial Sequence
  Description of Artificial Sequence:  Enzymatic Nucleic Acid
acttgggaggctagctacaacgaagcagaag

SEQ ID NO: 6647 - DNA, 31 bp, Artificial Sequence
  Description of Artificial Sequence:  Enzymatic Nucleic Acid
tactggcaggctagctacaacgattgggaca

SEQ ID NO: 6648 - DNA, 31 bp, Artificial Sequence
  Description of Artificial Sequence:  Enzymatic Nucleic Acid
gatactggggctagctacaacgaacttggga

SEQ ID NO: 6649 - DNA, 31 bp, Artificial Sequence
  Description of Artificial Sequence:  Enzymatic Nucleic Acid
gcctgataggctagctacaacgatggcactt

SEQ ID NO: 6650 - DNA, 31 bp, Artificial Sequence
  Description of Artificial Sequence:  Enzymatic Nucleic Acid
gggcctgaggctagctacaacgaactggcac

SEQ ID NO: 6651 - DNA, 31 bp, Artificial Sequence
  Description of Artificial Sequence:  Enzymatic Nucleic Acid
atcaggggggctagctacaacgactgatact

SEQ ID NO: 6652 - DNA, 31 bp, Artificial Sequence
  Description of Artificial Sequence:  Enzymatic Nucleic Acid
tgtccataggctagctacaacgacaggggcc

SEQ ID NO: 6653 - DNA, 31 bp, Artificial Sequence
  Description of Artificial Sequence:  Enzymatic Nucleic Acid
ggtgtccaggctagctacaacgaatcagggg

SEQ ID NO: 6654 - DNA, 31 bp, Artificial Sequence
  Description of Artificial Sequence:  Enzymatic Nucleic Acid
gcagggtgggctagctacaacgaccatatca

SEQ ID NO: 6655 - DNA, 31 bp, Artificial Sequence
  Description of Artificial Sequence:  Enzymatic Nucleic Acid
ctgcagggggctagctacaacgagtccatat

SEQ ID NO: 6656 - DNA, 31 bp, Artificial Sequence
  Description of Artificial Sequence:  Enzymatic Nucleic Acid
tgtatctgggctagctacaacgaagggtgtc

SEQ ID NO: 6657 - DNA, 31 bp, Artificial Sequence
  Description of Artificial Sequence:  Enzymatic Nucleic Acid
gacatgtaggctagctacaacgactgcaggg

SEQ ID NO: 6658 - DNA, 31 bp, Artificial Sequence
  Description of Artificial Sequence:  Enzymatic Nucleic Acid
atgacatgggctagctacaacgaatctgcag

SEQ ID NO: 6659 - DNA, 31 bp, Artificial Sequence
  Description of Artificial Sequence:  Enzymatic Nucleic Acid
ccatgacaggctagctacaacgagtatctgc

SEQ ID NO: 6660 - DNA, 31 bp, Artificial Sequence
  Description of Artificial Sequence:  Enzymatic Nucleic Acid
ctccatgaggctagctacaacgaatgtatct

SEQ ID NO: 6661 - DNA, 31 bp, Artificial Sequence
  Description of Artificial Sequence:  Enzymatic Nucleic Acid
gcactccaggctagctacaacgagacatgta

SEQ ID NO: 6662 - DNA, 31 bp, Artificial Sequence
  Description of Artificial Sequence:  Enzymatic Nucleic Acid
tcaatgcaggctagctacaacgatccatgac

SEQ ID NO: 6663 - DNA, 31 bp, Artificial Sequence
  Description of Artificial Sequence:  Enzymatic Nucleic Acid
actcaatgggctagctacaacgaactccatg

SEQ ID NO: 6664 - DNA, 31 bp, Artificial Sequence
  Description of Artificial Sequence:  Enzymatic Nucleic Acid
ctactcaaggctagctacaacgagcactcca

SEQ ID NO: 6665 - DNA, 31 bp, Artificial Sequence
  Description of Artificial Sequence:  Enzymatic Nucleic Acid
cggccctaggctagctacaacgatcaatgca

SEQ ID NO: 6666 - DNA, 31 bp, Artificial Sequence
  Description of Artificial Sequence:  Enzymatic Nucleic Acid
ctggccggggctagctacaacgacctactca

SEQ ID NO: 6667 - DNA, 31 bp, Artificial Sequence
  Description of Artificial Sequence:  Enzymatic Nucleic Acid
tgcactggggctagctacaacgacggcccta

SEQ ID NO: 6668 - DNA, 31 bp, Artificial Sequence
  Description of Artificial Sequence:  Enzymatic Nucleic Acid
gccttgcaggctagctacaacgatggccggc

SEQ ID NO: 6669 - DNA, 31 bp, Artificial Sequence
  Description of Artificial Sequence:  Enzymatic Nucleic Acid
tggccttgggctagctacaacgaactggccg

SEQ ID NO: 6670 - DNA, 31 bp, Artificial Sequence
  Description of Artificial Sequence:  Enzymatic Nucleic Acid
ggcagtggggctagctacaacgacttgcact

SEQ ID NO: 6671 - DNA, 31 bp, Artificial Sequence
  Description of Artificial Sequence:  Enzymatic Nucleic Acid
gcaggcagggctagctacaacgaggccttgc

SEQ ID NO: 6672 - DNA, 31 bp, Artificial Sequence
  Description of Artificial Sequence:  Enzymatic Nucleic Acid
cgggcaggggctagctacaacgaagtggcct

SEQ ID NO: 6673 - DNA, 31 bp, Artificial Sequence
  Description of Artificial Sequence:  Enzymatic Nucleic Acid
tcctcgggggctagctacaacgaaggcagtg

SEQ ID NO: 6674 - DNA, 31 bp, Artificial Sequence
  Description of Artificial Sequence:  Enzymatic Nucleic Acid
cgggcacgggctagctacaacgacctcgggc

SEQ ID NO: 6675 - DNA, 31 bp, Artificial Sequence
  Description of Artificial Sequence:  Enzymatic Nucleic Acid
cccgggcaggctagctacaacgagtcctcgg

SEQ ID NO: 6676 - DNA, 31 bp, Artificial Sequence
  Description of Artificial Sequence:  Enzymatic Nucleic Acid
gtcccgggggctagctacaacgaacgtcctc

SEQ ID NO: 6677 - DNA, 31 bp, Artificial Sequence
  Description of Artificial Sequence:  Enzymatic Nucleic Acid
ctgcacggggctagctacaacgacccgggca

SEQ ID NO: 6678 - DNA, 31 bp, Artificial Sequence
  Description of Artificial Sequence:  Enzymatic Nucleic Acid
agactgcaggctagctacaacgaggtcccgg

SEQ ID NO: 6679 - DNA, 31 bp, Artificial Sequence
  Description of Artificial Sequence:  Enzymatic Nucleic Acid
gcagactgggctagctacaacgaacggtccc

SEQ ID NO: 6680 - DNA, 31 bp, Artificial Sequence
  Description of Artificial Sequence:  Enzymatic Nucleic Acid
agcgcagaggctagctacaacgatgcacggt

SEQ ID NO: 6681 - DNA, 31 bp, Artificial Sequence
  Description of Artificial Sequence:  Enzymatic Nucleic Acid
ggaaagcgggctagctacaacgaagactgca

SEQ ID NO: 6682 - DNA, 31 bp, Artificial Sequence
  Description of Artificial Sequence:  Enzymatic Nucleic Acid
gaggaaagggctagctacaacgagcagactg

SEQ ID NO: 6683 - DNA, 31 bp, Artificial Sequence
  Description of Artificial Sequence:  Enzymatic Nucleic Acid
taggcaggggctagctacaacgagggagagg

SEQ ID NO: 6684 - DNA, 31 bp, Artificial Sequence
  Description of Artificial Sequence:  Enzymatic Nucleic Acid
gggctaggggctagctacaacgaaggcggga

SEQ ID NO: 6685 - DNA, 31 bp, Artificial Sequence
  Description of Artificial Sequence:  Enzymatic Nucleic Acid
atcctgggggctagctacaacgataggcagg

SEQ ID NO: 6686 - DNA, 31 bp, Artificial Sequence
  Description of Artificial Sequence:  Enzymatic Nucleic Acid
gcccttcaggctagctacaacgacctgggct

SEQ ID NO: 6687 - DNA, 31 bp, Artificial Sequence
  Description of Artificial Sequence:  Enzymatic Nucleic Acid
ccacccagggctagctacaacgaccttcatc

SEQ ID NO: 6688 - DNA, 31 bp, Artificial Sequence
  Description of Artificial Sequence:  Enzymatic Nucleic Acid
tgtggccaggctagctacaacgaccagccct

SEQ ID NO: 6689 - DNA, 31 bp, Artificial Sequence
  Description of Artificial Sequence:  Enzymatic Nucleic Acid
agttgtggggctagctacaacgacacccagc

SEQ ID NO: 6690 - DNA, 31 bp, Artificial Sequence
  Description of Artificial Sequence:  Enzymatic Nucleic Acid
cccagttgggctagctacaacgaggccaccc

SEQ ID NO: 6691 - DNA, 31 bp, Artificial Sequence
  Description of Artificial Sequence:  Enzymatic Nucleic Acid
catcccagggctagctacaacgatgtggcca

SEQ ID NO: 6692 - DNA, 31 bp, Artificial Sequence
  Description of Artificial Sequence:  Enzymatic Nucleic Acid
aggtggcaggctagctacaacgacccagttg

SEQ ID NO: 6693 - DNA, 31 bp, Artificial Sequence
  Description of Artificial Sequence:  Enzymatic Nucleic Acid
ccaggtggggctagctacaacgaatcccagt

SEQ ID NO: 6694 - DNA, 31 bp, Artificial Sequence
  Description of Artificial Sequence:  Enzymatic Nucleic Acid
gctccaggggctagctacaacgaggcatccc

SEQ ID NO: 6695 - DNA, 31 bp, Artificial Sequence
  Description of Artificial Sequence:  Enzymatic Nucleic Acid
gggtggggggctagctacaacgatccaggtg

SEQ ID NO: 6696 - DNA, 31 bp, Artificial Sequence
  Description of Artificial Sequence:  Enzymatic Nucleic Acid
ctcctgggggctagctacaacgaggggctcc

SEQ ID NO: 6697 - DNA, 31 bp, Artificial Sequence
  Description of Artificial Sequence:  Enzymatic Nucleic Acid
gcggccagggctagctacaacgatcctgggt

SEQ ID NO: 6698 - DNA, 31 bp, Artificial Sequence
  Description of Artificial Sequence:  Enzymatic Nucleic Acid
tgccgcggggctagctacaacgacagctcct

SEQ ID NO: 6699 - DNA, 31 bp, Artificial Sequence
  Description of Artificial Sequence:  Enzymatic Nucleic Acid
aggtgccgggctagctacaacgaggccagct

SEQ ID NO: 6700 - DNA, 31 bp, Artificial Sequence
  Description of Artificial Sequence:  Enzymatic Nucleic Acid
gtaaggtgggctagctacaacgacgcggcca

SEQ ID NO: 6701 - DNA, 31 bp, Artificial Sequence
  Description of Artificial Sequence:  Enzymatic Nucleic Acid
gcgtaaggggctagctacaacgagccgcggc

SEQ ID NO: 6702 - DNA, 31 bp, Artificial Sequence
  Description of Artificial Sequence:  Enzymatic Nucleic Acid
ctgaagcgggctagctacaacgaaaggtgcc

SEQ ID NO: 6703 - DNA, 31 bp, Artificial Sequence
  Description of Artificial Sequence:  Enzymatic Nucleic Acid
agctgaagggctagctacaacgagtaaggtg

SEQ ID NO: 6704 - DNA, 31 bp, Artificial Sequence
  Description of Artificial Sequence:  Enzymatic Nucleic Acid
atcaacagggctagctacaacgatgaagcgt

SEQ ID NO: 6705 - DNA, 31 bp, Artificial Sequence
  Description of Artificial Sequence:  Enzymatic Nucleic Acid
cggatcaaggctagctacaacgaagctgaag

SEQ ID NO: 6706 - DNA, 31 bp, Artificial Sequence
  Description of Artificial Sequence:  Enzymatic Nucleic Acid
ccagcggaggctagctacaacgacaacagct

SEQ ID NO: 6707 - DNA, 31 bp, Artificial Sequence
  Description of Artificial Sequence:  Enzymatic Nucleic Acid
gggaccagggctagctacaacgaggatcaac

SEQ ID NO: 6708 - DNA, 31 bp, Artificial Sequence
  Description of Artificial Sequence:  Enzymatic Nucleic Acid
agaggggaggctagctacaacgacagcggat

SEQ ID NO: 6709 - DNA, 31 bp, Artificial Sequence
  Description of Artificial Sequence:  Enzymatic Nucleic Acid
cgcatctaggctagctacaacgacccaaaag

SEQ ID NO: 6710 - DNA, 31 bp, Artificial Sequence
  Description of Artificial Sequence:  Enzymatic Nucleic Acid
gggccgcaggctagctacaacgactacccca

SEQ ID NO: 6711 - DNA, 31 bp, Artificial Sequence
  Description of Artificial Sequence:  Enzymatic Nucleic Acid
cggggccgggctagctacaacgaatctaccc

SEQ ID NO: 6712 - DNA, 31 bp, Artificial Sequence
  Description of Artificial Sequence:  Enzymatic Nucleic Acid
gatcggggggctagctacaacgacgcatcta

SEQ ID NO: 6713 - DNA, 31 bp, Artificial Sequence
  Description of Artificial Sequence:  Enzymatic Nucleic Acid
aggcctgaggctagctacaacgacggggccg

SEQ ID NO: 6714 - DNA, 31 bp, Artificial Sequence
  Description of Artificial Sequence:  Enzymatic Nucleic Acid
gagtcaggggctagctacaacgactgatcgg

SEQ ID NO: 6715 - DNA, 31 bp, Artificial Sequence
  Description of Artificial Sequence:  Enzymatic Nucleic Acid
gcagcgagggctagctacaacgacaggcctg

SEQ ID NO: 6716 - DNA, 31 bp, Artificial Sequence
  Description of Artificial Sequence:  Enzymatic Nucleic Acid
aagagcagggctagctacaacgagagtcagg

SEQ ID NO: 6717 - DNA, 31 bp, Artificial Sequence
  Description of Artificial Sequence:  Enzymatic Nucleic Acid
aaaaagagggctagctacaacgaagcgagtc

SEQ ID NO: 6718 - DNA, 31 bp, Artificial Sequence
  Description of Artificial Sequence:  Enzymatic Nucleic Acid
gaagggaaggctagctacaacgaaaaaagag

SEQ ID NO: 6719 - DNA, 31 bp, Artificial Sequence
  Description of Artificial Sequence:  Enzymatic Nucleic Acid
cgagcagaggctagctacaacgaagaaggga

SEQ ID NO: 6720 - DNA, 31 bp, Artificial Sequence
  Description of Artificial Sequence:  Enzymatic Nucleic Acid
ggttcgagggctagctacaacgaagacagaa

SEQ ID NO: 6721 - DNA, 31 bp, Artificial Sequence
  Description of Artificial Sequence:  Enzymatic Nucleic Acid
gcaagtggggctagctacaacgatcgagcag

SEQ ID NO: 6722 - DNA, 31 bp, Artificial Sequence
  Description of Artificial Sequence:  Enzymatic Nucleic Acid
gaggcaagggctagctacaacgaggttcgag

SEQ ID NO: 6723 - DNA, 31 bp, Artificial Sequence
  Description of Artificial Sequence:  Enzymatic Nucleic Acid
gcccgaggggctagctacaacgaaagtggtt

SEQ ID NO: 6724 - DNA, 31 bp, Artificial Sequence
  Description of Artificial Sequence:  Enzymatic Nucleic Acid
gggattagggctagctacaacgaccgaggca

SEQ ID NO: 6725 - DNA, 31 bp, Artificial Sequence
  Description of Artificial Sequence:  Enzymatic Nucleic Acid
gggagggaggctagctacaacgatagcccga

SEQ ID NO: 6726 - DNA, 31 bp, Artificial Sequence
  Description of Artificial Sequence:  Enzymatic Nucleic Acid
gtgccgggggctagctacaacgaggaggaag

SEQ ID NO: 6727 - DNA, 31 bp, Artificial Sequence
  Description of Artificial Sequence:  Enzymatic Nucleic Acid
ccccagtgggctagctacaacgacgggtgga

SEQ ID NO: 6728 - DNA, 31 bp, Artificial Sequence
  Description of Artificial Sequence:  Enzymatic Nucleic Acid
ttccccagggctagctacaacgagccgggtg

SEQ ID NO: 6729 - DNA, 31 bp, Artificial Sequence
  Description of Artificial Sequence:  Enzymatic Nucleic Acid
attcttgaggctagctacaacgattccccag

SEQ ID NO: 6730 - DNA, 31 bp, Artificial Sequence
  Description of Artificial Sequence:  Enzymatic Nucleic Acid
aggccccaggctagctacaacgatcttgact

SEQ ID NO: 6731 - DNA, 31 bp, Artificial Sequence
  Description of Artificial Sequence:  Enzymatic Nucleic Acid
gccccaggggctagctacaacgacccattct

SEQ ID NO: 6732 - DNA, 31 bp, Artificial Sequence
  Description of Artificial Sequence:  Enzymatic Nucleic Acid
cctgagagggctagctacaacgacccaggcc

SEQ ID NO: 6733 - DNA, 31 bp, Artificial Sequence
  Description of Artificial Sequence:  Enzymatic Nucleic Acid
ggaagcagggctagctacaacgatctccctg

SEQ ID NO: 6734 - DNA, 31 bp, Artificial Sequence
  Description of Artificial Sequence:  Enzymatic Nucleic Acid
aggggaagggctagctacaacgaagttctcc

SEQ ID NO: 6735 - DNA, 31 bp, Artificial Sequence
  Description of Artificial Sequence:  Enzymatic Nucleic Acid
cagctctgggctagctacaacgacaggggaa

SEQ ID NO: 6736 - DNA, 31 bp, Artificial Sequence
  Description of Artificial Sequence:  Enzymatic Nucleic Acid
ccacccagggctagctacaacgatctgccag

SEQ ID NO: 6737 - DNA, 31 bp, Artificial Sequence
  Description of Artificial Sequence:  Enzymatic Nucleic Acid
agctgccaggctagctacaacgaccagctct

SEQ ID NO: 6738 - DNA, 31 bp, Artificial Sequence
  Description of Artificial Sequence:  Enzymatic Nucleic Acid
aagagctgggctagctacaacgacacccagc

SEQ ID NO: 6739 - DNA, 31 bp, Artificial Sequence
  Description of Artificial Sequence:  Enzymatic Nucleic Acid
aggaagagggctagctacaacgatgccaccc

SEQ ID NO: 6740 - DNA, 31 bp, Artificial Sequence
  Description of Artificial Sequence:  Enzymatic Nucleic Acid
gtgtccggggctagctacaacgagggaggaa

SEQ ID NO: 6741 - DNA, 31 bp, Artificial Sequence
  Description of Artificial Sequence:  Enzymatic Nucleic Acid
ggtcggtgggctagctacaacgaccggtggg

SEQ ID NO: 6742 - DNA, 31 bp, Artificial Sequence
  Description of Artificial Sequence:  Enzymatic Nucleic Acid
cgggtcggggctagctacaacgagtccggtg

SEQ ID NO: 6743 - DNA, 31 bp, Artificial Sequence
  Description of Artificial Sequence:  Enzymatic Nucleic Acid
cgggcgggggctagctacaacgacggtgtcc

SEQ ID NO: 6744 - DNA, 31 bp, Artificial Sequence
  Description of Artificial Sequence:  Enzymatic Nucleic Acid
gcggcgggggctagctacaacgagggtcggt

SEQ ID NO: 6745 - DNA, 31 bp, Artificial Sequence
  Description of Artificial Sequence:  Enzymatic Nucleic Acid
cacagcggggctagctacaacgagggcgggt

SEQ ID NO: 6746 - DNA, 31 bp, Artificial Sequence
  Description of Artificial Sequence:  Enzymatic Nucleic Acid
gggcacagggctagctacaacgaggcgggcg

SEQ ID NO: 6747 - DNA, 31 bp, Artificial Sequence
  Description of Artificial Sequence:  Enzymatic Nucleic Acid
ccagggcaggctagctacaacgaagcggcgg

SEQ ID NO: 6748 - DNA, 31 bp, Artificial Sequence
  Description of Artificial Sequence:  Enzymatic Nucleic Acid
tcccagggggctagctacaacgaacagcggc

SEQ ID NO: 6749 - DNA, 31 bp, Artificial Sequence
  Description of Artificial Sequence:  Enzymatic Nucleic Acid
gggcagcaggctagctacaacgatcccaggg

SEQ ID NO: 6750 - DNA, 31 bp, Artificial Sequence
  Description of Artificial Sequence:  Enzymatic Nucleic Acid
gagggcagggctagctacaacgaactcccag

SEQ ID NO: 6751 - DNA, 31 bp, Artificial Sequence
  Description of Artificial Sequence:  Enzymatic Nucleic Acid
taagagggggctagctacaacgaagcactcc

SEQ ID NO: 6752 - DNA, 31 bp, Artificial Sequence
  Description of Artificial Sequence:  Enzymatic Nucleic Acid
gtgcatggggctagctacaacgaaagagggc

SEQ ID NO: 6753 - DNA, 31 bp, Artificial Sequence
  Description of Artificial Sequence:  Enzymatic Nucleic Acid
cgtgtgcaggctagctacaacgaggtaagag

SEQ ID NO: 6754 - DNA, 31 bp, Artificial Sequence
  Description of Artificial Sequence:  Enzymatic Nucleic Acid
cccgtgtgggctagctacaacgaatggtaag

SEQ ID NO: 6755 - DNA, 31 bp, Artificial Sequence
  Description of Artificial Sequence:  Enzymatic Nucleic Acid
cacccgtgggctagctacaacgagcatggta

SEQ ID NO: 6756 - DNA, 31 bp, Artificial Sequence
  Description of Artificial Sequence:  Enzymatic Nucleic Acid
agcacccgggctagctacaacgagtgcatgg

SEQ ID NO: 6757 - DNA, 31 bp, Artificial Sequence
  Description of Artificial Sequence:  Enzymatic Nucleic Acid
ggagagcaggctagctacaacgaccgtgtgc

SEQ ID NO: 6758 - DNA, 31 bp, Artificial Sequence
  Description of Artificial Sequence:  Enzymatic Nucleic Acid
aaggagagggctagctacaacgaacccgtgt

SEQ ID NO: 6759 - DNA, 31 bp, Artificial Sequence
  Description of Artificial Sequence:  Enzymatic Nucleic Acid
gcatgcagggctagctacaacgaccaaaagg

SEQ ID NO: 6760 - DNA, 31 bp, Artificial Sequence
  Description of Artificial Sequence:  Enzymatic Nucleic Acid
atagcatgggctagctacaacgaagcccaaa

SEQ ID NO: 6761 - DNA, 31 bp, Artificial Sequence
  Description of Artificial Sequence:  Enzymatic Nucleic Acid
gaatagcaggctagctacaacgagcagccca

SEQ ID NO: 6762 - DNA, 31 bp, Artificial Sequence
  Description of Artificial Sequence:  Enzymatic Nucleic Acid
tggaatagggctagctacaacgaatgcagcc

SEQ ID NO: 6763 - DNA, 31 bp, Artificial Sequence
  Description of Artificial Sequence:  Enzymatic Nucleic Acid
aaatggaaggctagctacaacgaagcatgca

SEQ ID NO: 6764 - DNA, 31 bp, Artificial Sequence
  Description of Artificial Sequence:  Enzymatic Nucleic Acid
ctgcaaaaggctagctacaacgaggaatagc

SEQ ID NO: 6765 - DNA, 31 bp, Artificial Sequence
  Description of Artificial Sequence:  Enzymatic Nucleic Acid
tctggctgggctagctacaacgaaaaatgga

SEQ ID NO: 6766 - DNA, 31 bp, Artificial Sequence
  Description of Artificial Sequence:  Enzymatic Nucleic Acid
cggtctggggctagctacaacgatgcaaaat

SEQ ID NO: 6767 - DNA, 31 bp, Artificial Sequence
  Description of Artificial Sequence:  Enzymatic Nucleic Acid
cacatcggggctagctacaacgactggctgc

SEQ ID NO: 6768 - DNA, 31 bp, Artificial Sequence
  Description of Artificial Sequence:  Enzymatic Nucleic Acid
aatacacaggctagctacaacgacggtctgg

SEQ ID NO: 6769 - DNA, 31 bp, Artificial Sequence
  Description of Artificial Sequence:  Enzymatic Nucleic Acid
taaatacaggctagctacaacgaatcggtct

SEQ ID NO: 6770 - DNA, 31 bp, Artificial Sequence
  Description of Artificial Sequence:  Enzymatic Nucleic Acid
gttaaataggctagctacaacgaacatcggt

SEQ ID NO: 6771 - DNA, 31 bp, Artificial Sequence
  Description of Artificial Sequence:  Enzymatic Nucleic Acid
tggttaaaggctagctacaacgaacacatcg

SEQ ID NO: 6772 - DNA, 31 bp, Artificial Sequence
  Description of Artificial Sequence:  Enzymatic Nucleic Acid
gtgactggggctagctacaacgataaataca

SEQ ID NO: 6773 - DNA, 31 bp, Artificial Sequence
  Description of Artificial Sequence:  Enzymatic Nucleic Acid
aatagtgaggctagctacaacgatggttaaa

SEQ ID NO: 6774 - DNA, 31 bp, Artificial Sequence
  Description of Artificial Sequence:  Enzymatic Nucleic Acid
atcaatagggctagctacaacgagactggtt

SEQ ID NO: 6775 - DNA, 31 bp, Artificial Sequence
  Description of Artificial Sequence:  Enzymatic Nucleic Acid
tccatcaaggctagctacaacgaagtgactg

SEQ ID NO: 6776 - DNA, 31 bp, Artificial Sequence
  Description of Artificial Sequence:  Enzymatic Nucleic Acid
aatgtccaggctagctacaacgacaatagtg

SEQ ID NO: 6777 - DNA, 31 bp, Artificial Sequence
  Description of Artificial Sequence:  Enzymatic Nucleic Acid
cccaaatgggctagctacaacgaccatcaat

SEQ ID NO: 6778 - DNA, 31 bp, Artificial Sequence
  Description of Artificial Sequence:  Enzymatic Nucleic Acid
aacccaaaggctagctacaacgagtccatca

SEQ ID NO: 6779 - DNA, 31 bp, Artificial Sequence
  Description of Artificial Sequence:  Enzymatic Nucleic Acid
ggaaacaaggctagctacaacgaccaaatgt

SEQ ID NO: 6780 - DNA, 31 bp, Artificial Sequence
  Description of Artificial Sequence:  Enzymatic Nucleic Acid
atgggaaaggctagctacaacgaaacccaaa

SEQ ID NO: 6781 - DNA, 31 bp, Artificial Sequence
  Description of Artificial Sequence:  Enzymatic Nucleic Acid
caaaaagaggctagctacaacgagggaaaca

SEQ ID NO: 6782 - DNA, 31 bp, Artificial Sequence
  Description of Artificial Sequence:  Enzymatic Nucleic Acid
tatggtaaggctagctacaacgaaaaaagat

SEQ ID NO: 6783 - DNA, 31 bp, Artificial Sequence
  Description of Artificial Sequence:  Enzymatic Nucleic Acid
atttatggggctagctacaacgaaacaaaaa

SEQ ID NO: 6784 - DNA, 31 bp, Artificial Sequence
  Description of Artificial Sequence:  Enzymatic Nucleic Acid
attatttaggctagctacaacgaggtaacaa

SEQ ID NO: 6785 - DNA, 31 bp, Artificial Sequence
  Description of Artificial Sequence:  Enzymatic Nucleic Acid
tgccattaggctagctacaacgattatggta

SEQ ID NO: 6786 - DNA, 31 bp, Artificial Sequence
  Description of Artificial Sequence:  Enzymatic Nucleic Acid
ctatgccaggctagctacaacgatatttatg

SEQ ID NO: 6787 - DNA, 31 bp, Artificial Sequence
  Description of Artificial Sequence:  Enzymatic Nucleic Acid
ttactatgggctagctacaacgacattattt

SEQ ID NO: 6788 - DNA, 31 bp, Artificial Sequence
  Description of Artificial Sequence:  Enzymatic Nucleic Acid
ttttactaggctagctacaacgagccattat

SEQ ID NO: 6789 - DNA, 31 bp, Artificial Sequence
  Description of Artificial Sequence:  Enzymatic Nucleic Acid
tttttttaggctagctacaacgatatgccat

SEQ ID NO: 6790 - RNA, 17 nt, Homo sapiens
acgagcauggcccuugu

SEQ ID NO: 6791 - RNA, 17 nt, Homo sapiens
gcccuugugauccaggu

SEQ ID NO: 6792 - RNA, 17 nt, Homo sapiens
gugauccagguggggaa

SEQ ID NO: 6793 - RNA, 17 nt, Homo sapiens
auccagguggggaaacu

SEQ ID NO: 6794 - RNA, 17 nt, Homo sapiens
uccagguggggaaacua

SEQ ID NO: 6795 - RNA, 17 nt, Homo sapiens
ccagguggggaaacuaa

SEQ ID NO: 6796 - RNA, 17 nt, Homo sapiens
cagguggggaaacuaag

SEQ ID NO: 6797 - RNA, 17 nt, Homo sapiens
gaaacuaaggcccagag

SEQ ID NO: 6798 - RNA, 17 nt, Homo sapiens
aaggcccagagaaguga

SEQ ID NO: 6799 - RNA, 17 nt, Homo sapiens
ggcccagagaagugagg

SEQ ID NO: 6800 - RNA, 17 nt, Homo sapiens
agagaagugaggacccc

SEQ ID NO: 6801 - RNA, 17 nt, Homo sapiens
agaagugaggaccccgc

SEQ ID NO: 6802 - RNA, 17 nt, Homo sapiens
gaagugaggaccccgca

SEQ ID NO: 6803 - RNA, 17 nt, Homo sapiens
accccgcagacuaucaa

SEQ ID NO: 6804 - RNA, 17 nt, Homo sapiens
cucccugugaagcucuc

SEQ ID NO: 6805 - RNA, 17 nt, Homo sapiens
gcaucaucgagguccca

SEQ ID NO: 6806 - RNA, 17 nt, Homo sapiens
aucaucgaggucccauc

SEQ ID NO: 6807 - RNA, 17 nt, Homo sapiens
gcccuguuggaugaaua

SEQ ID NO: 6808 - RNA, 17 nt, Homo sapiens
cccuguuggaugaauag

SEQ ID NO: 6809 - RNA, 17 nt, Homo sapiens
uguuggaugaauaggca

SEQ ID NO: 6810 - RNA, 17 nt, Homo sapiens
gaugaauaggcaccucu

SEQ ID NO: 6811 - RNA, 17 nt, Homo sapiens
gcaccucuggaagagcc

SEQ ID NO: 6812 - RNA, 17 nt, Homo sapiens
caccucuggaagagcca

SEQ ID NO: 6813 - RNA, 17 nt, Homo sapiens
cucuggaagagccaacu

SEQ ID NO: 6814 - RNA, 17 nt, Homo sapiens
aacugugugagauggug

SEQ ID NO: 6815 - RNA, 17 nt, Homo sapiens
cugugugagauggugca

SEQ ID NO: 6816 - RNA, 17 nt, Homo sapiens
ugugagauggugcagcc

SEQ ID NO: 6817 - RNA, 17 nt, Homo sapiens
agcccagugguggcccg

SEQ ID NO: 6818 - RNA, 17 nt, Homo sapiens
ccagugguggcccggca

SEQ ID NO: 6819 - RNA, 17 nt, Homo sapiens
gguggcccggcagcaga

SEQ ID NO: 6820 - RNA, 17 nt, Homo sapiens
cggcagcagaucaggac

SEQ ID NO: 6821 - RNA, 17 nt, Homo sapiens
gcagaucaggacguacu

SEQ ID NO: 6822 - RNA, 17 nt, Homo sapiens
cagaucaggacguacug

SEQ ID NO: 6823 - RNA, 17 nt, Homo sapiens
gacguacugggcgaaga

SEQ ID NO: 6824 - RNA, 17 nt, Homo sapiens
acguacugggcgaagag

SEQ ID NO: 6825 - RNA, 17 nt, Homo sapiens
uacugggcgaagagucu

SEQ ID NO: 6826 - RNA, 17 nt, Homo sapiens
ugggcgaagagucuccu

SEQ ID NO: 6827 - RNA, 17 nt, Homo sapiens
ucuccucuggggaagcc

SEQ ID NO: 6828 - RNA, 17 nt, Homo sapiens
cuccucuggggaagcca

SEQ ID NO: 6829 - RNA, 17 nt, Homo sapiens
uccucuggggaagccag

SEQ ID NO: 6830 - RNA, 17 nt, Homo sapiens
ccucuggggaagccagc

SEQ ID NO: 6831 - RNA, 17 nt, Homo sapiens
ugccuucagaacagggc

SEQ ID NO: 6832 - RNA, 17 nt, Homo sapiens
ucagaacagggcgcucc

SEQ ID NO: 6833 - RNA, 17 nt, Homo sapiens
cagaacagggcgcuccu

SEQ ID NO: 6834 - RNA, 17 nt, Homo sapiens
gcgcuccugagacccuc

SEQ ID NO: 6835 - RNA, 17 nt, Homo sapiens
gcuccugagacccucca

SEQ ID NO: 6836 - RNA, 17 nt, Homo sapiens
cgcugccuggaggagaa

SEQ ID NO: 6837 - RNA, 17 nt, Homo sapiens
gcugccuggaggagaau

SEQ ID NO: 6838 - RNA, 17 nt, Homo sapiens
ugccuggaggagaauca

SEQ ID NO: 6839 - RNA, 17 nt, Homo sapiens
gccuggaggagaaucaa

SEQ ID NO: 6840 - RNA, 17 nt, Homo sapiens
cuggaggagaaucaaga

SEQ ID NO: 6841 - RNA, 17 nt, Homo sapiens
agaaucaagagcuccga

SEQ ID NO: 6842 - RNA, 17 nt, Homo sapiens
agagcuccgagaugcca

SEQ ID NO: 6843 - RNA, 17 nt, Homo sapiens
agcuccgagaugccauc

SEQ ID NO: 6844 - RNA, 17 nt, Homo sapiens
ugccauccggcagagca

SEQ ID NO: 6845 - RNA, 17 nt, Homo sapiens
auccggcagagcaacca

SEQ ID NO: 6846 - RNA, 17 nt, Homo sapiens
agcaaccagauucugcg

SEQ ID NO: 6847 - RNA, 17 nt, Homo sapiens
gauucugcgggagcgcu

SEQ ID NO: 6848 - RNA, 17 nt, Homo sapiens
auucugcgggagcgcug

SEQ ID NO: 6849 - RNA, 17 nt, Homo sapiens
uucugcgggagcgcugc

SEQ ID NO: 6850 - RNA, 17 nt, Homo sapiens
agcgcugcgaggagcuu

SEQ ID NO: 6851 - RNA, 17 nt, Homo sapiens
cgcugcgaggagcuucu

SEQ ID NO: 6852 - RNA, 17 nt, Homo sapiens
gcugcgaggagcuucug

SEQ ID NO: 6853 - RNA, 17 nt, Homo sapiens
gccagccagagggagga

SEQ ID NO: 6854 - RNA, 17 nt, Homo sapiens
cagccagagggaggaga

SEQ ID NO: 6855 - RNA, 17 nt, Homo sapiens
agccagagggaggagaa

SEQ ID NO: 6856 - RNA, 17 nt, Homo sapiens
gccagagggaggagaag

SEQ ID NO: 6857 - RNA, 17 nt, Homo sapiens
cagagggaggagaagga

SEQ ID NO: 6858 - RNA, 17 nt, Homo sapiens
agagggaggagaaggag

SEQ ID NO: 6859 - RNA, 17 nt, Homo sapiens
agggaggagaaggaguu

SEQ ID NO: 6860 - RNA, 17 nt, Homo sapiens
gaggagaaggaguuccu

SEQ ID NO: 6861 - RNA, 17 nt, Homo sapiens
aggagaaggaguuccuc

SEQ ID NO: 6862 - RNA, 17 nt, Homo sapiens
aaguuccaggaggccag

SEQ ID NO: 6863 - RNA, 17 nt, Homo sapiens
aguuccaggaggccagg

SEQ ID NO: 6864 - RNA, 17 nt, Homo sapiens
uuccaggaggccaggaa

SEQ ID NO: 6865 - RNA, 17 nt, Homo sapiens
ggaggccaggaaacugg

SEQ ID NO: 6866 - RNA, 17 nt, Homo sapiens
gaggccaggaaacuggu

SEQ ID NO: 6867 - RNA, 17 nt, Homo sapiens
aggaaacugguggagag

SEQ ID NO: 6868 - RNA, 17 nt, Homo sapiens
aaacugguggagagacu

SEQ ID NO: 6869 - RNA, 17 nt, Homo sapiens
aacugguggagagacuc

SEQ ID NO: 6870 - RNA, 17 nt, Homo sapiens
cugguggagagacucgg

SEQ ID NO: 6871 - RNA, 17 nt, Homo sapiens
gguggagagacucggcc

SEQ ID NO: 6872 - RNA, 17 nt, Homo sapiens
agagacucggccuggag

SEQ ID NO: 6873 - RNA, 17 nt, Homo sapiens
cucggccuggagaagcu

SEQ ID NO: 6874 - RNA, 17 nt, Homo sapiens
ucggccuggagaagcuc

SEQ ID NO: 6875 - RNA, 17 nt, Homo sapiens
ggccuggagaagcucga

SEQ ID NO: 6876 - RNA, 17 nt, Homo sapiens
agaagcucgaucugaag

SEQ ID NO: 6877 - RNA, 17 nt, Homo sapiens
cucgaucugaagaggca

SEQ ID NO: 6878 - RNA, 17 nt, Homo sapiens
gaucugaagaggcagaa

SEQ ID NO: 6879 - RNA, 17 nt, Homo sapiens
ucugaagaggcagaagg

SEQ ID NO: 6880 - RNA, 17 nt, Homo sapiens
aagaggcagaaggagca

SEQ ID NO: 6881 - RNA, 17 nt, Homo sapiens
aggcagaaggagcaggc

SEQ ID NO: 6882 - RNA, 17 nt, Homo sapiens
ggcagaaggagcaggcu

SEQ ID NO: 6883 - RNA, 17 nt, Homo sapiens
aaggagcaggcucugcg

SEQ ID NO: 6884 - RNA, 17 nt, Homo sapiens
ggcucugcgggaggugg

SEQ ID NO: 6885 - RNA, 17 nt, Homo sapiens
gcucugcgggaggugga

SEQ ID NO: 6886 - RNA, 17 nt, Homo sapiens
cucugcgggagguggag

SEQ ID NO: 6887 - RNA, 17 nt, Homo sapiens
cugcgggagguggagca

SEQ ID NO: 6888 - RNA, 17 nt, Homo sapiens
cgggagguggagcaccu

SEQ ID NO: 6889 - RNA, 17 nt, Homo sapiens
gggagguggagcaccug

SEQ ID NO: 6890 - RNA, 17 nt, Homo sapiens
gagcaccugaagagaug

SEQ ID NO: 6891 - RNA, 17 nt, Homo sapiens
caccugaagagaugcca

SEQ ID NO: 6892 - RNA, 17 nt, Homo sapiens
ccugaagagaugccagc

SEQ ID NO: 6893 - RNA, 17 nt, Homo sapiens
cagcagcagauggcuga

SEQ ID NO: 6894 - RNA, 17 nt, Homo sapiens
cagcagauggcugagga

SEQ ID NO: 6895 - RNA, 17 nt, Homo sapiens
agauggcugaggacaag

SEQ ID NO: 6896 - RNA, 17 nt, Homo sapiens
auggcugaggacaaggc

SEQ ID NO: 6897 - RNA, 17 nt, Homo sapiens
uggcugaggacaaggcc

SEQ ID NO: 6898 - RNA, 17 nt, Homo sapiens
gaggacaaggccucugu

SEQ ID NO: 6899 - RNA, 17 nt, Homo sapiens
gccucugugaaagccca

SEQ ID NO: 6900 - RNA, 17 nt, Homo sapiens
aaagcccaggugacguc

SEQ ID NO: 6901 - RNA, 17 nt, Homo sapiens
gcccaggugacguccuu

SEQ ID NO: 6902 - RNA, 17 nt, Homo sapiens
ccuugcucggggagcug

SEQ ID NO: 6903 - RNA, 17 nt, Homo sapiens
cuugcucggggagcugc

SEQ ID NO: 6904 - RNA, 17 nt, Homo sapiens
uugcucggggagcugca

SEQ ID NO: 6905 - RNA, 17 nt, Homo sapiens
ugcucggggagcugcag

SEQ ID NO: 6906 - RNA, 17 nt, Homo sapiens
gagcugcaggagagcca

SEQ ID NO: 6907 - RNA, 17 nt, Homo sapiens
agcugcaggagagccag

SEQ ID NO: 6908 - RNA, 17 nt, Homo sapiens
cugcaggagagccagag

SEQ ID NO: 6909 - RNA, 17 nt, Homo sapiens
gagagccagagucgcuu

SEQ ID NO: 6910 - RNA, 17 nt, Homo sapiens
agucgcuuggaggcugc

SEQ ID NO: 6911 - RNA, 17 nt, Homo sapiens
gucgcuuggaggcugcc

SEQ ID NO: 6912 - RNA, 17 nt, Homo sapiens
cgcuuggaggcugccac

SEQ ID NO: 6913 - RNA, 17 nt, Homo sapiens
gccacuaaggaaugcca

SEQ ID NO: 6914 - RNA, 17 nt, Homo sapiens
ccacuaaggaaugccag

SEQ ID NO: 6915 - RNA, 17 nt, Homo sapiens
gaaugccaggcucugga

SEQ ID NO: 6916 - RNA, 17 nt, Homo sapiens
caggcucuggagggucg

SEQ ID NO: 6917 - RNA, 17 nt, Homo sapiens
aggcucuggagggucgg

SEQ ID NO: 6918 - RNA, 17 nt, Homo sapiens
gcucuggagggucgggc

SEQ ID NO: 6919 - RNA, 17 nt, Homo sapiens
cucuggagggucgggcc

SEQ ID NO: 6920 - RNA, 17 nt, Homo sapiens
ggagggucgggcccggg

SEQ ID NO: 6921 - RNA, 17 nt, Homo sapiens
gagggucgggcccgggc

SEQ ID NO: 6922 - RNA, 17 nt, Homo sapiens
ucgggcccgggcggcca

SEQ ID NO: 6923 - RNA, 17 nt, Homo sapiens
cgggcccgggcggccag

SEQ ID NO: 6924 - RNA, 17 nt, Homo sapiens
gcccgggcggccagcga

SEQ ID NO: 6925 - RNA, 17 nt, Homo sapiens
cggccagcgagcaggcg

SEQ ID NO: 6926 - RNA, 17 nt, Homo sapiens
agcgagcaggcgcggca

SEQ ID NO: 6927 - RNA, 17 nt, Homo sapiens
gcaggcgcggcagcugg

SEQ ID NO: 6928 - RNA, 17 nt, Homo sapiens
cggcagcuggagaguga

SEQ ID NO: 6929 - RNA, 17 nt, Homo sapiens
ggcagcuggagagugag

SEQ ID NO: 6930 - RNA, 17 nt, Homo sapiens
cagcuggagagugagcg

SEQ ID NO: 6931 - RNA, 17 nt, Homo sapiens
uggagagugagcgcgag

SEQ ID NO: 6932 - RNA, 17 nt, Homo sapiens
gugagcgcgaggcgcug

SEQ ID NO: 6933 - RNA, 17 nt, Homo sapiens
gagcgcgaggcgcugca

SEQ ID NO: 6934 - RNA, 17 nt, Homo sapiens
agcgugcagguggacca

SEQ ID NO: 6935 - RNA, 17 nt, Homo sapiens
gugcagguggaccagcu

SEQ ID NO: 6936 - RNA, 17 nt, Homo sapiens
ugcagguggaccagcug

SEQ ID NO: 6937 - RNA, 17 nt, Homo sapiens
cgcaugcagggccagag

SEQ ID NO: 6938 - RNA, 17 nt, Homo sapiens
gcaugcagggccagagc

SEQ ID NO: 6939 - RNA, 17 nt, Homo sapiens
cagggccagagcgugga

SEQ ID NO: 6940 - RNA, 17 nt, Homo sapiens
cagagcguggaggccgc

SEQ ID NO: 6941 - RNA, 17 nt, Homo sapiens
agagcguggaggccgcg

SEQ ID NO: 6942 - RNA, 17 nt, Homo sapiens
agcguggaggccgcgcu

SEQ ID NO: 6943 - RNA, 17 nt, Homo sapiens
cuccgcauggagcgcca

SEQ ID NO: 6944 - RNA, 17 nt, Homo sapiens
uccgcauggagcgccag

SEQ ID NO: 6945 - RNA, 17 nt, Homo sapiens
gagcgccaggccgccuc

SEQ ID NO: 6946 - RNA, 17 nt, Homo sapiens
gccgccucggaggagaa

SEQ ID NO: 6947 - RNA, 17 nt, Homo sapiens
ccgccucggaggagaag

SEQ ID NO: 6948 - RNA, 17 nt, Homo sapiens
gccucggaggagaagag

SEQ ID NO: 6949 - RNA, 17 nt, Homo sapiens
ccucggaggagaagagg

SEQ ID NO: 6950 - RNA, 17 nt, Homo sapiens
ucggaggagaagaggaa

SEQ ID NO: 6951 - RNA, 17 nt, Homo sapiens
gaggagaagaggaagcu

SEQ ID NO: 6952 - RNA, 17 nt, Homo sapiens
ggagaagaggaagcugg

SEQ ID NO: 6953 - RNA, 17 nt, Homo sapiens
gagaagaggaagcuggc

SEQ ID NO: 6954 - RNA, 17 nt, Homo sapiens
aggaagcuggcccaguu

SEQ ID NO: 6955 - RNA, 17 nt, Homo sapiens
caguugcagguggccua

SEQ ID NO: 6956 - RNA, 17 nt, Homo sapiens
uugcagguggccuauca

SEQ ID NO: 6957 - RNA, 17 nt, Homo sapiens
ucuuccaagaauacgac

SEQ ID NO: 6958 - RNA, 17 nt, Homo sapiens
aagaauacgacaaccac

SEQ ID NO: 6959 - RNA, 17 nt, Homo sapiens
cacaucaagagcagcgu

SEQ ID NO: 6960 - RNA, 17 nt, Homo sapiens
agcagcguggugggcag

SEQ ID NO: 6961 - RNA, 17 nt, Homo sapiens
agcguggugggcaguga

SEQ ID NO: 6962 - RNA, 17 nt, Homo sapiens
gcguggugggcagugag

SEQ ID NO: 6963 - RNA, 17 nt, Homo sapiens
ugggcagugagcggaag

SEQ ID NO: 6964 - RNA, 17 nt, Homo sapiens
cagugagcggaagcgag

SEQ ID NO: 6965 - RNA, 17 nt, Homo sapiens
agugagcggaagcgagg

SEQ ID NO: 6966 - RNA, 17 nt, Homo sapiens
gcggaagcgaggaaugc

SEQ ID NO: 6967 - RNA, 17 nt, Homo sapiens
ggaagcgaggaaugcag

SEQ ID NO: 6968 - RNA, 17 nt, Homo sapiens
gaagcgaggaaugcagc

SEQ ID NO: 6969 - RNA, 17 nt, Homo sapiens
augcagcuggaagaucu

SEQ ID NO: 6970 - RNA, 17 nt, Homo sapiens
ugcagcuggaagaucuc

SEQ ID NO: 6971 - RNA, 17 nt, Homo sapiens
agcuggaagaucucaaa

SEQ ID NO: 6972 - RNA, 17 nt, Homo sapiens
cuccagcaggccgagga

SEQ ID NO: 6973 - RNA, 17 nt, Homo sapiens
agcaggccgaggaggcc

SEQ ID NO: 6974 - RNA, 17 nt, Homo sapiens
caggccgaggaggcccu

SEQ ID NO: 6975 - RNA, 17 nt, Homo sapiens
aggccgaggaggcccug

SEQ ID NO: 6976 - RNA, 17 nt, Homo sapiens
gccgaggaggcccuggu

SEQ ID NO: 6977 - RNA, 17 nt, Homo sapiens
gaggcccugguggccaa

SEQ ID NO: 6978 - RNA, 17 nt, Homo sapiens
gcccugguggccaaaca

SEQ ID NO: 6979 - RNA, 17 nt, Homo sapiens
gccaaacaggaggugau

SEQ ID NO: 6980 - RNA, 17 nt, Homo sapiens
ccaaacaggaggugauc

SEQ ID NO: 6981 - RNA, 17 nt, Homo sapiens
aaacaggaggugaucga

SEQ ID NO: 6982 - RNA, 17 nt, Homo sapiens
caggaggugaucgauaa

SEQ ID NO: 6983 - RNA, 17 nt, Homo sapiens
aggugaucgauaagcug

SEQ ID NO: 6984 - RNA, 17 nt, Homo sapiens
gauaagcugaaggagga

SEQ ID NO: 6985 - RNA, 17 nt, Homo sapiens
aagcugaaggaggaggc

SEQ ID NO: 6986 - RNA, 17 nt, Homo sapiens
agcugaaggaggaggcc

SEQ ID NO: 6987 - RNA, 17 nt, Homo sapiens
cugaaggaggaggccga

SEQ ID NO: 6988 - RNA, 17 nt, Homo sapiens
ugaaggaggaggccgag

SEQ ID NO: 6989 - RNA, 17 nt, Homo sapiens
aaggaggaggccgagca

SEQ ID NO: 6990 - RNA, 17 nt, Homo sapiens
aggaggccgagcagcac

SEQ ID NO: 6991 - RNA, 17 nt, Homo sapiens
cagcacaagauugugau

SEQ ID NO: 6992 - RNA, 17 nt, Homo sapiens
aagauugugauggagac

SEQ ID NO: 6993 - RNA, 17 nt, Homo sapiens
auugugauggagaccgu

SEQ ID NO: 6994 - RNA, 17 nt, Homo sapiens
uugugauggagaccguu

SEQ ID NO: 6995 - RNA, 17 nt, Homo sapiens
gugauggagaccguucc

SEQ ID NO: 6996 - RNA, 17 nt, Homo sapiens
accguuccggugcugaa

SEQ ID NO: 6997 - RNA, 17 nt, Homo sapiens
ccggugcugaaggccca

SEQ ID NO: 6998 - RNA, 17 nt, Homo sapiens
gugcugaaggcccaggc

SEQ ID NO: 6999 - RNA, 17 nt, Homo sapiens
aaggcccaggcggauau

SEQ ID NO: 7000 - RNA, 17 nt, Homo sapiens
gcccaggcggauaucua

SEQ ID NO: 7001 - RNA, 17 nt, Homo sapiens
cccaggcggauaucuac

SEQ ID NO: 7002 - RNA, 17 nt, Homo sapiens
aucuacaaggcggacuu

SEQ ID NO: 7003 - RNA, 17 nt, Homo sapiens
uacaaggcggacuucca

SEQ ID NO: 7004 - RNA, 17 nt, Homo sapiens
acaaggcggacuuccag

SEQ ID NO: 7005 - RNA, 17 nt, Homo sapiens
gacuuccaggcugagag

SEQ ID NO: 7006 - RNA, 17 nt, Homo sapiens
uccaggcugagaggcag

SEQ ID NO: 7007 - RNA, 17 nt, Homo sapiens
caggcugagaggcaggc

SEQ ID NO: 7008 - RNA, 17 nt, Homo sapiens
ggcugagaggcaggccc

SEQ ID NO: 7009 - RNA, 17 nt, Homo sapiens
gagaggcaggcccggga

SEQ ID NO: 7010 - RNA, 17 nt, Homo sapiens
gcaggcccgggagaagc

SEQ ID NO: 7011 - RNA, 17 nt, Homo sapiens
caggcccgggagaagcu

SEQ ID NO: 7012 - RNA, 17 nt, Homo sapiens
aggcccgggagaagcug

SEQ ID NO: 7013 - RNA, 17 nt, Homo sapiens
gcccgggagaagcuggc

SEQ ID NO: 7014 - RNA, 17 nt, Homo sapiens
gagaagcuggccgagaa

SEQ ID NO: 7015 - RNA, 17 nt, Homo sapiens
agcuggccgagaagaag

SEQ ID NO: 7016 - RNA, 17 nt, Homo sapiens
cuggccgagaagaagga

SEQ ID NO: 7017 - RNA, 17 nt, Homo sapiens
gccgagaagaaggagcu

SEQ ID NO: 7018 - RNA, 17 nt, Homo sapiens
gagaagaaggagcuccu

SEQ ID NO: 7019 - RNA, 17 nt, Homo sapiens
agaagaaggagcuccug

SEQ ID NO: 7020 - RNA, 17 nt, Homo sapiens
cuccugcaggagcagcu

SEQ ID NO: 7021 - RNA, 17 nt, Homo sapiens
uccugcaggagcagcug

SEQ ID NO: 7022 - RNA, 17 nt, Homo sapiens
gagcagcuggagcagcu

SEQ ID NO: 7023 - RNA, 17 nt, Homo sapiens
agcagcuggagcagcug

SEQ ID NO: 7024 - RNA, 17 nt, Homo sapiens
cagcugcagagggagua

SEQ ID NO: 7025 - RNA, 17 nt, Homo sapiens
gcugcagagggaguaca

SEQ ID NO: 7026 - RNA, 17 nt, Homo sapiens
cugcagagggaguacag

SEQ ID NO: 7027 - RNA, 17 nt, Homo sapiens
ugcagagggaguacagc

SEQ ID NO: 7028 - RNA, 17 nt, Homo sapiens
agcaaacugaaggccag

SEQ ID NO: 7029 - RNA, 17 nt, Homo sapiens
aaacugaaggccagcug

SEQ ID NO: 7030 - RNA, 17 nt, Homo sapiens
agcugucaggagucggc

SEQ ID NO: 7031 - RNA, 17 nt, Homo sapiens
gcugucaggagucggcc

SEQ ID NO: 7032 - RNA, 17 nt, Homo sapiens
caggagucggccaggau

SEQ ID NO: 7033 - RNA, 17 nt, Homo sapiens
gucggccaggaucgagg

SEQ ID NO: 7034 - RNA, 17 nt, Homo sapiens
ucggccaggaucgagga

SEQ ID NO: 7035 - RNA, 17 nt, Homo sapiens
ccaggaucgaggacaug

SEQ ID NO: 7036 - RNA, 17 nt, Homo sapiens
aggaucgaggacaugag

SEQ ID NO: 7037 - RNA, 17 nt, Homo sapiens
ggaucgaggacaugagg

SEQ ID NO: 7038 - RNA, 17 nt, Homo sapiens
gaggacaugaggaagcg

SEQ ID NO: 7039 - RNA, 17 nt, Homo sapiens
ggacaugaggaagcggc

SEQ ID NO: 7040 - RNA, 17 nt, Homo sapiens
gacaugaggaagcggca

SEQ ID NO: 7041 - RNA, 17 nt, Homo sapiens
gaggaagcggcaugucg

SEQ ID NO: 7042 - RNA, 17 nt, Homo sapiens
ggcaugucgaggucucc

SEQ ID NO: 7043 - RNA, 17 nt, Homo sapiens
caugucgaggucuccca

SEQ ID NO: 7044 - RNA, 17 nt, Homo sapiens
gucucccaggcccccuu

SEQ ID NO: 7045 - RNA, 17 nt, Homo sapiens
ucuccccuggcccugcc

SEQ ID NO: 7046 - RNA, 17 nt, Homo sapiens
cccagccagaggaggag

SEQ ID NO: 7047 - RNA, 17 nt, Homo sapiens
cagccagaggaggagcc

SEQ ID NO: 7048 - RNA, 17 nt, Homo sapiens
agccagaggaggagccc

SEQ ID NO: 7049 - RNA, 17 nt, Homo sapiens
ccagaggaggagccccc

SEQ ID NO: 7050 - RNA, 17 nt, Homo sapiens
cagaggaggagcccccc

SEQ ID NO: 7051 - RNA, 17 nt, Homo sapiens
gcccccccgaggagcca

SEQ ID NO: 7052 - RNA, 17 nt, Homo sapiens
ccccccgaggagccacc

SEQ ID NO: 7053 - RNA, 17 nt, Homo sapiens
cccccgaggagccaccu

SEQ ID NO: 7054 - RNA, 17 nt, Homo sapiens
agccaccugacuucugc

SEQ ID NO: 7055 - RNA, 17 nt, Homo sapiens
caguaucaggccccuga

SEQ ID NO: 7056 - RNA, 17 nt, Homo sapiens
aggccccugauauggac

SEQ ID NO: 7057 - RNA, 17 nt, Homo sapiens
ccugauauggacacccu

SEQ ID NO: 7058 - RNA, 17 nt, Homo sapiens
cugauauggacacccug

SEQ ID NO: 7059 - RNA, 17 nt, Homo sapiens
acccugcagauacaugu

SEQ ID NO: 7060 - RNA, 17 nt, Homo sapiens
caugucauggagugcau

SEQ ID NO: 7061 - RNA, 17 nt, Homo sapiens
augucauggagugcauu

SEQ ID NO: 7062 - RNA, 17 nt, Homo sapiens
agugcauugaguagggc

SEQ ID NO: 7063 - RNA, 17 nt, Homo sapiens
auugaguagggccggcc

SEQ ID NO: 7064 - RNA, 17 nt, Homo sapiens
uugaguagggccggcca

SEQ ID NO: 7065 - RNA, 17 nt, Homo sapiens
guagggccggccagugc

SEQ ID NO: 7066 - RNA, 17 nt, Homo sapiens
cagugcaaggccacugc

SEQ ID NO: 7067 - RNA, 17 nt, Homo sapiens
gccugcccgaggacgug

SEQ ID NO: 7068 - RNA, 17 nt, Homo sapiens
cugcccgaggacgugcc

SEQ ID NO: 7069 - RNA, 17 nt, Homo sapiens
ugcccgaggacgugccc

SEQ ID NO: 7070 - RNA, 17 nt, Homo sapiens
acgugcccgggaccgug

SEQ ID NO: 7071 - RNA, 17 nt, Homo sapiens
cgugcccgggaccgugc

SEQ ID NO: 7072 - RNA, 17 nt, Homo sapiens
gugcccgggaccgugca

SEQ ID NO: 7073 - RNA, 17 nt, Homo sapiens
cuagcccaggaugaagg

SEQ ID NO: 7074 - RNA, 17 nt, Homo sapiens
uagcccaggaugaaggg

SEQ ID NO: 7075 - RNA, 17 nt, Homo sapiens
cccaggaugaagggcug

SEQ ID NO: 7076 - RNA, 17 nt, Homo sapiens
aggaugaagggcugggu

SEQ ID NO: 7077 - RNA, 17 nt, Homo sapiens
ggaugaagggcugggug

SEQ ID NO: 7078 - RNA, 17 nt, Homo sapiens
gaagggcuggguggcca

SEQ ID NO: 7079 - RNA, 17 nt, Homo sapiens
aagggcuggguggccac

SEQ ID NO: 7080 - RNA, 17 nt, Homo sapiens
ggcuggguggccacaac

SEQ ID NO: 7081 - RNA, 17 nt, Homo sapiens
ccacaacugggaugcca

SEQ ID NO: 7082 - RNA, 17 nt, Homo sapiens
cacaacugggaugccac

SEQ ID NO: 7083 - RNA, 17 nt, Homo sapiens
acaacugggaugccacc

SEQ ID NO: 7084 - RNA, 17 nt, Homo sapiens
ugccaccuggagcccca

SEQ ID NO: 7085 - RNA, 17 nt, Homo sapiens
gccaccuggagccccac

SEQ ID NO: 7086 - RNA, 17 nt, Homo sapiens
cccacccaggagcuggc

SEQ ID NO: 7087 - RNA, 17 nt, Homo sapiens
ccacccaggagcuggcc

SEQ ID NO: 7088 - RNA, 17 nt, Homo sapiens
caggagcuggccgcggc

SEQ ID NO: 7089 - RNA, 17 nt, Homo sapiens
cuggccgcggcaccuua

SEQ ID NO: 7090 - RNA, 17 nt, Homo sapiens
cagcuguugauccgcug

SEQ ID NO: 7091 - RNA, 17 nt, Homo sapiens
gauccgcugguccccuc

SEQ ID NO: 7092 - RNA, 17 nt, Homo sapiens
ccucuuuugggguagau

SEQ ID NO: 7093 - RNA, 17 nt, Homo sapiens
cucuuuugggguagaug

SEQ ID NO: 7094 - RNA, 17 nt, Homo sapiens
ucuuuugggguagaugc

SEQ ID NO: 7095 - RNA, 17 nt, Homo sapiens
uugggguagaugcggcc

SEQ ID NO: 7096 - RNA, 17 nt, Homo sapiens
guagaugcggccccgau

SEQ ID NO: 7097 - RNA, 17 nt, Homo sapiens
gcggccccgaucaggcc

SEQ ID NO: 7098 - RNA, 17 nt, Homo sapiens
cccgaucaggccugacu

SEQ ID NO: 7099 - RNA, 17 nt, Homo sapiens
ucaggccugacucgcug

SEQ ID NO: 7100 - RNA, 17 nt, Homo sapiens
gucugcucgaaccacuu

SEQ ID NO: 7101 - RNA, 17 nt, Homo sapiens
cuugccucgggcuaauc

SEQ ID NO: 7102 - RNA, 17 nt, Homo sapiens
uugccucgggcuaaucc

SEQ ID NO: 7103 - RNA, 17 nt, Homo sapiens
cuccacccggcacuggg

SEQ ID NO: 7104 - RNA, 17 nt, Homo sapiens
ccggcacuggggaaguc

SEQ ID NO: 7105 - RNA, 17 nt, Homo sapiens
cggcacuggggaaguca

SEQ ID NO: 7106 - RNA, 17 nt, Homo sapiens
ggcacuggggaagucaa

SEQ ID NO: 7107 - RNA, 17 nt, Homo sapiens
gcacuggggaagucaag

SEQ ID NO: 7108 - RNA, 17 nt, Homo sapiens
gaagucaagaauggggc

SEQ ID NO: 7109 - RNA, 17 nt, Homo sapiens
ucaagaauggggccugg

SEQ ID NO: 7110 - RNA, 17 nt, Homo sapiens
caagaauggggccuggg

SEQ ID NO: 7111 - RNA, 17 nt, Homo sapiens
aagaauggggccugggg

SEQ ID NO: 7112 - RNA, 17 nt, Homo sapiens
uggggccuggggcucuc

SEQ ID NO: 7113 - RNA, 17 nt, Homo sapiens
ggggccuggggcucuca

SEQ ID NO: 7114 - RNA, 17 nt, Homo sapiens
gggccuggggcucucag

SEQ ID NO: 7115 - RNA, 17 nt, Homo sapiens
ggcucucagggagaacu

SEQ ID NO: 7116 - RNA, 17 nt, Homo sapiens
gcucucagggagaacug

SEQ ID NO: 7117 - RNA, 17 nt, Homo sapiens
cucucagggagaacugc

SEQ ID NO: 7118 - RNA, 17 nt, Homo sapiens
cucagggagaacugcuu

SEQ ID NO: 7119 - RNA, 17 nt, Homo sapiens
cuuccccuggcagagcu

SEQ ID NO: 7120 - RNA, 17 nt, Homo sapiens
cccuggcagagcugggu

SEQ ID NO: 7121 - RNA, 17 nt, Homo sapiens
gcagagcuggguggcag

SEQ ID NO: 7122 - RNA, 17 nt, Homo sapiens
cagagcuggguggcagc

SEQ ID NO: 7123 - RNA, 17 nt, Homo sapiens
agcuggguggcagcucu

SEQ ID NO: 7124 - RNA, 17 nt, Homo sapiens
cucccaccggacaccga

SEQ ID NO: 7125 - RNA, 17 nt, Homo sapiens
ucccaccggacaccgac

SEQ ID NO: 7126 - RNA, 17 nt, Homo sapiens
cggacaccgacccgccc

SEQ ID NO: 7127 - RNA, 17 nt, Homo sapiens
ugugcccugggagugcu

SEQ ID NO: 7128 - RNA, 17 nt, Homo sapiens
gugcccugggagugcug

SEQ ID NO: 7129 - RNA, 17 nt, Homo sapiens
ugcccugggagugcugc

SEQ ID NO: 7130 - RNA, 17 nt, Homo sapiens
augcacacgggugcucu

SEQ ID NO: 7131 - RNA, 17 nt, Homo sapiens
ugcacacgggugcucuc

SEQ ID NO: 7132 - RNA, 17 nt, Homo sapiens
cuccuuuugggcugcau

SEQ ID NO: 7133 - RNA, 17 nt, Homo sapiens
uccuuuugggcugcaug

SEQ ID NO: 7134 - RNA, 17 nt, Homo sapiens
ugcagccagaccgaugu

SEQ ID NO: 7135 - RNA, 17 nt, Homo sapiens
gccagaccgauguguau

SEQ ID NO: 7136 - RNA, 17 nt, Homo sapiens
ucacuauugauggacau

SEQ ID NO: 7137 - RNA, 17 nt, Homo sapiens
cuauugauggacauuug

SEQ ID NO: 7138 - RNA, 17 nt, Homo sapiens
uauugauggacauuugg

SEQ ID NO: 7139 - RNA, 17 nt, Homo sapiens
ggacauuuggguuguuu

SEQ ID NO: 7140 - RNA, 17 nt, Homo sapiens
gacauuuggguuguuuc

SEQ ID NO: 7141 - RNA, 17 nt, Homo sapiens
uaaauaauggcauagua

SEQ ID NO: 7142 - RNA, 48 nt, Artificial Sequence
  Description of Artificial Sequence:  Enzymatic Nucleic Acid
acaagggcggaggaaacucccuucaaggacaucguccgggaugcucgu

SEQ ID NO: 7143 - RNA, 48 nt, Artificial Sequence
  Description of Artificial Sequence:  Enzymatic Nucleic Acid
cacaagggggaggaaacucccuucaaggacaucguccgggcaugcucg

SEQ ID NO: 7144 - RNA, 48 nt, Artificial Sequence
  Description of Artificial Sequence:  Enzymatic Nucleic Acid
cuggaucaggaggaaacucccuucaaggacaucguccgggaagggcca

SEQ ID NO: 7145 - RNA, 48 nt, Artificial Sequence
  Description of Artificial Sequence:  Enzymatic Nucleic Acid
accuggauggaggaaacucccuucaaggacaucguccgggacaagggc

SEQ ID NO: 7146 - RNA, 48 nt, Artificial Sequence
  Description of Artificial Sequence:  Enzymatic Nucleic Acid
uuccccacggaggaaacucccuucaaggacaucguccggguggaucac

SEQ ID NO: 7147 - RNA, 48 nt, Artificial Sequence
  Description of Artificial Sequence:  Enzymatic Nucleic Acid
uuuccccaggaggaaacucccuucaaggacaucguccgggcuggauca

SEQ ID NO: 7148 - RNA, 48 nt, Artificial Sequence
  Description of Artificial Sequence:  Enzymatic Nucleic Acid
aguuucccggaggaaacucccuucaaggacaucguccgggaccuggau

SEQ ID NO: 7149 - RNA, 48 nt, Artificial Sequence
  Description of Artificial Sequence:  Enzymatic Nucleic Acid
uaguuuccggaggaaacucccuucaaggacaucguccgggcaccugga

SEQ ID NO: 7150 - RNA, 48 nt, Artificial Sequence
  Description of Artificial Sequence:  Enzymatic Nucleic Acid
uuaguuucggaggaaacucccuucaaggacaucguccgggccaccugg

SEQ ID NO: 7151 - RNA, 48 nt, Artificial Sequence
  Description of Artificial Sequence:  Enzymatic Nucleic Acid
cuuaguuuggaggaaacucccuucaaggacaucguccgggcccaccug

SEQ ID NO: 7152 - RNA, 48 nt, Artificial Sequence
  Description of Artificial Sequence:  Enzymatic Nucleic Acid
cucugggcggaggaaacucccuucaaggacaucguccggguuaguuuc

SEQ ID NO: 7153 - RNA, 48 nt, Artificial Sequence
  Description of Artificial Sequence:  Enzymatic Nucleic Acid
ucucugggggaggaaacucccuucaaggacaucguccgggcuuaguuu

SEQ ID NO: 7154 - RNA, 48 nt, Artificial Sequence
  Description of Artificial Sequence:  Enzymatic Nucleic Acid
ucacuucuggaggaaacucccuucaaggacaucguccgggugggccuu

SEQ ID NO: 7155 - RNA, 48 nt, Artificial Sequence
  Description of Artificial Sequence:  Enzymatic Nucleic Acid
ccucacuuggaggaaacucccuucaaggacaucguccgggucugggcc

SEQ ID NO: 7156 - RNA, 48 nt, Artificial Sequence
  Description of Artificial Sequence:  Enzymatic Nucleic Acid
gguccucaggaggaaacucccuucaaggacaucguccggguucucugg

SEQ ID NO: 7157 - RNA, 48 nt, Artificial Sequence
  Description of Artificial Sequence:  Enzymatic Nucleic Acid
gggguccuggaggaaacucccuucaaggacaucguccgggacuucucu

SEQ ID NO: 7158 - RNA, 48 nt, Artificial Sequence
  Description of Artificial Sequence:  Enzymatic Nucleic Acid
gcggggucggaggaaacucccuucaaggacaucguccgggucacuucu

SEQ ID NO: 7159 - RNA, 48 nt, Artificial Sequence
  Description of Artificial Sequence:  Enzymatic Nucleic Acid
ugcgggguggaggaaacucccuucaaggacaucguccgggcucacuuc

SEQ ID NO: 7160 - RNA, 48 nt, Artificial Sequence
  Description of Artificial Sequence:  Enzymatic Nucleic Acid
auagucugggaggaaacucccuucaaggacaucguccggggggguccu

SEQ ID NO: 7161 - RNA, 48 nt, Artificial Sequence
  Description of Artificial Sequence:  Enzymatic Nucleic Acid
uugauaguggaggaaacucccuucaaggacaucguccgggugcggggu

SEQ ID NO: 7162 - RNA, 48 nt, Artificial Sequence
  Description of Artificial Sequence:  Enzymatic Nucleic Acid
ggaagagaggaggaaacucccuucaaggacaucguccgggugggauug

SEQ ID NO: 7163 - RNA, 48 nt, Artificial Sequence
  Description of Artificial Sequence:  Enzymatic Nucleic Acid
gagcuucaggaggaaacucccuucaaggacaucguccgggagggagug

SEQ ID NO: 7164 - RNA, 48 nt, Artificial Sequence
  Description of Artificial Sequence:  Enzymatic Nucleic Acid
gagagcuuggaggaaacucccuucaaggacaucguccgggacagggag

SEQ ID NO: 7165 - RNA, 48 nt, Artificial Sequence
  Description of Artificial Sequence:  Enzymatic Nucleic Acid
cuggagagggaggaaacucccuucaaggacaucguccggguucacagg

SEQ ID NO: 7166 - RNA, 48 nt, Artificial Sequence
  Description of Artificial Sequence:  Enzymatic Nucleic Acid
cgaugaugggaggaaacucccuucaaggacaucguccggguggagagc

SEQ ID NO: 7167 - RNA, 48 nt, Artificial Sequence
  Description of Artificial Sequence:  Enzymatic Nucleic Acid
ugggaccuggaggaaacucccuucaaggacaucguccggggaugaugc

SEQ ID NO: 7168 - RNA, 48 nt, Artificial Sequence
  Description of Artificial Sequence:  Enzymatic Nucleic Acid
gaugggacggaggaaacucccuucaaggacaucguccgggucgaugau

SEQ ID NO: 7169 - RNA, 48 nt, Artificial Sequence
  Description of Artificial Sequence:  Enzymatic Nucleic Acid
ugaugggaggaggaaacucccuucaaggacaucguccgggcucgauga

SEQ ID NO: 7170 - RNA, 48 nt, Artificial Sequence
  Description of Artificial Sequence:  Enzymatic Nucleic Acid
ggcaagggggaggaaacucccuucaaggacaucguccgggugauggga

SEQ ID NO: 7171 - RNA, 48 nt, Artificial Sequence
  Description of Artificial Sequence:  Enzymatic Nucleic Acid
caacagggggaggaaacucccuucaaggacaucguccgggaagggcug

SEQ ID NO: 7172 - RNA, 48 nt, Artificial Sequence
  Description of Artificial Sequence:  Enzymatic Nucleic Acid
ucauccaaggaggaaacucccuucaaggacaucguccgggagggcaag

SEQ ID NO: 7173 - RNA, 48 nt, Artificial Sequence
  Description of Artificial Sequence:  Enzymatic Nucleic Acid
uauucaucggaggaaacucccuucaaggacaucguccgggaacagggc

SEQ ID NO: 7174 - RNA, 48 nt, Artificial Sequence
  Description of Artificial Sequence:  Enzymatic Nucleic Acid
cuauucauggaggaaacucccuucaaggacaucguccgggcaacaggg

SEQ ID NO: 7175 - RNA, 48 nt, Artificial Sequence
  Description of Artificial Sequence:  Enzymatic Nucleic Acid
ugccuauuggaggaaacucccuucaaggacaucguccgggauccaaca

SEQ ID NO: 7176 - RNA, 48 nt, Artificial Sequence
  Description of Artificial Sequence:  Enzymatic Nucleic Acid
agaggugcggaggaaacucccuucaaggacaucguccggguauucauc

SEQ ID NO: 7177 - RNA, 48 nt, Artificial Sequence
  Description of Artificial Sequence:  Enzymatic Nucleic Acid
cagaggugggaggaaacucccuucaaggacaucguccgggcuauucau

SEQ ID NO: 7178 - RNA, 48 nt, Artificial Sequence
  Description of Artificial Sequence:  Enzymatic Nucleic Acid
ggcucuucggaggaaacucccuucaaggacaucguccgggagaggugc

SEQ ID NO: 7179 - RNA, 48 nt, Artificial Sequence
  Description of Artificial Sequence:  Enzymatic Nucleic Acid
uggcucuuggaggaaacucccuucaaggacaucguccgggcagaggug

SEQ ID NO: 7180 - RNA, 48 nt, Artificial Sequence
  Description of Artificial Sequence:  Enzymatic Nucleic Acid
aguuggcuggaggaaacucccuucaaggacaucguccggguuccagag

SEQ ID NO: 7181 - RNA, 48 nt, Artificial Sequence
  Description of Artificial Sequence:  Enzymatic Nucleic Acid
acaguuggggaggaaacucccuucaaggacaucguccgggucuuccag

SEQ ID NO: 7182 - RNA, 48 nt, Artificial Sequence
  Description of Artificial Sequence:  Enzymatic Nucleic Acid
aucucacaggaggaaacucccuucaaggacaucguccgggaguuggcu

SEQ ID NO: 7183 - RNA, 48 nt, Artificial Sequence
  Description of Artificial Sequence:  Enzymatic Nucleic Acid
ccaucucaggaggaaacucccuucaaggacaucguccgggacaguugg

SEQ ID NO: 7184 - RNA, 48 nt, Artificial Sequence
  Description of Artificial Sequence:  Enzymatic Nucleic Acid
caccaucuggaggaaacucccuucaaggacaucguccgggacacaguu

SEQ ID NO: 7185 - RNA, 48 nt, Artificial Sequence
  Description of Artificial Sequence:  Enzymatic Nucleic Acid
ugcaccauggaggaaacucccuucaaggacaucguccgggucacacag

SEQ ID NO: 7186 - RNA, 48 nt, Artificial Sequence
  Description of Artificial Sequence:  Enzymatic Nucleic Acid
ggcugcacggaggaaacucccuucaaggacaucguccgggaucucaca

SEQ ID NO: 7187 - RNA, 48 nt, Artificial Sequence
  Description of Artificial Sequence:  Enzymatic Nucleic Acid
gggcugcaggaggaaacucccuucaaggacaucguccgggcaucucac

SEQ ID NO: 7188 - RNA, 48 nt, Artificial Sequence
  Description of Artificial Sequence:  Enzymatic Nucleic Acid
cugggcugggaggaaacucccuucaaggacaucguccgggaccaucuc

SEQ ID NO: 7189 - RNA, 48 nt, Artificial Sequence
  Description of Artificial Sequence:  Enzymatic Nucleic Acid
ccacugggggaggaaacucccuucaaggacaucguccgggugcaccau

SEQ ID NO: 7190 - RNA, 48 nt, Artificial Sequence
  Description of Artificial Sequence:  Enzymatic Nucleic Acid
ggccaccaggaggaaacucccuucaaggacaucguccgggugggcugc

SEQ ID NO: 7191 - RNA, 48 nt, Artificial Sequence
  Description of Artificial Sequence:  Enzymatic Nucleic Acid
cgggccacggaggaaacucccuucaaggacaucguccgggacugggcu

SEQ ID NO: 7192 - RNA, 48 nt, Artificial Sequence
  Description of Artificial Sequence:  Enzymatic Nucleic Acid
ccgggccaggaggaaacucccuucaaggacaucguccgggcacugggc

SEQ ID NO: 7193 - RNA, 48 nt, Artificial Sequence
  Description of Artificial Sequence:  Enzymatic Nucleic Acid
ugccgggcggaggaaacucccuucaaggacaucguccgggaccacugg

SEQ ID NO: 7194 - RNA, 48 nt, Artificial Sequence
  Description of Artificial Sequence:  Enzymatic Nucleic Acid
cugccgggggaggaaacucccuucaaggacaucguccgggcaccacug

SEQ ID NO: 7195 - RNA, 48 nt, Artificial Sequence
  Description of Artificial Sequence:  Enzymatic Nucleic Acid
ucugcugcggaggaaacucccuucaaggacaucguccggggggccacc

SEQ ID NO: 7196 - RNA, 48 nt, Artificial Sequence
  Description of Artificial Sequence:  Enzymatic Nucleic Acid
aucugcugggaggaaacucccuucaaggacaucguccgggcgggccac

SEQ ID NO: 7197 - RNA, 48 nt, Artificial Sequence
  Description of Artificial Sequence:  Enzymatic Nucleic Acid
cugaucugggaggaaacucccuucaaggacaucguccgggugccgggc

SEQ ID NO: 7198 - RNA, 48 nt, Artificial Sequence
  Description of Artificial Sequence:  Enzymatic Nucleic Acid
guccugauggaggaaacucccuucaaggacaucguccgggugcugccg

SEQ ID NO: 7199 - RNA, 48 nt, Artificial Sequence
  Description of Artificial Sequence:  Enzymatic Nucleic Acid
aguacgucggaggaaacucccuucaaggacaucguccgggugaucugc

SEQ ID NO: 7200 - RNA, 48 nt, Artificial Sequence
  Description of Artificial Sequence:  Enzymatic Nucleic Acid
caguacguggaggaaacucccuucaaggacaucguccgggcugaucug

SEQ ID NO: 7201 - RNA, 48 nt, Artificial Sequence
  Description of Artificial Sequence:  Enzymatic Nucleic Acid
gcccaguaggaggaaacucccuucaaggacaucguccgggguccugau

SEQ ID NO: 7202 - RNA, 48 nt, Artificial Sequence
  Description of Artificial Sequence:  Enzymatic Nucleic Acid
ucuucgccggaggaaacucccuucaaggacaucguccgggaguacguc

SEQ ID NO: 7203 - RNA, 48 nt, Artificial Sequence
  Description of Artificial Sequence:  Enzymatic Nucleic Acid
cucuucgcggaggaaacucccuucaaggacaucguccgggcaguacgu

SEQ ID NO: 7204 - RNA, 48 nt, Artificial Sequence
  Description of Artificial Sequence:  Enzymatic Nucleic Acid
acucuucgggaggaaacucccuucaaggacaucguccgggccaguacg

SEQ ID NO: 7205 - RNA, 48 nt, Artificial Sequence
  Description of Artificial Sequence:  Enzymatic Nucleic Acid
agacucuuggaggaaacucccuucaaggacaucguccggggcccagua

SEQ ID NO: 7206 - RNA, 48 nt, Artificial Sequence
  Description of Artificial Sequence:  Enzymatic Nucleic Acid
aggagacuggaggaaacucccuucaaggacaucguccggguucgccca

SEQ ID NO: 7207 - RNA, 48 nt, Artificial Sequence
  Description of Artificial Sequence:  Enzymatic Nucleic Acid
agaggagaggaggaaacucccuucaaggacaucguccgggucuucgcc

SEQ ID NO: 7208 - RNA, 48 nt, Artificial Sequence
  Description of Artificial Sequence:  Enzymatic Nucleic Acid
ggcuucccggaggaaacucccuucaaggacaucguccgggagaggaga

SEQ ID NO: 7209 - RNA, 48 nt, Artificial Sequence
  Description of Artificial Sequence:  Enzymatic Nucleic Acid
uggcuuccggaggaaacucccuucaaggacaucguccgggcagaggag

SEQ ID NO: 7210 - RNA, 48 nt, Artificial Sequence
  Description of Artificial Sequence:  Enzymatic Nucleic Acid
cuggcuucggaggaaacucccuucaaggacaucguccgggccagagga

SEQ ID NO: 7211 - RNA, 48 nt, Artificial Sequence
  Description of Artificial Sequence:  Enzymatic Nucleic Acid
gcuggcuuggaggaaacucccuucaaggacaucguccgggcccagagg

SEQ ID NO: 7212 - RNA, 48 nt, Artificial Sequence
  Description of Artificial Sequence:  Enzymatic Nucleic Acid
auggcuggggaggaaacucccuucaaggacaucguccggguuccccag

SEQ ID NO: 7213 - RNA, 48 nt, Artificial Sequence
  Description of Artificial Sequence:  Enzymatic Nucleic Acid
cagcauggggaggaaacucccuucaaggacaucguccggguggcuucc

SEQ ID NO: 7214 - RNA, 48 nt, Artificial Sequence
  Description of Artificial Sequence:  Enzymatic Nucleic Acid
aggugcagggaggaaacucccuucaaggacaucguccgggauggcugg

SEQ ID NO: 7215 - RNA, 48 nt, Artificial Sequence
  Description of Artificial Sequence:  Enzymatic Nucleic Acid
ggcaggugggaggaaacucccuucaaggacaucguccgggagcauggc

SEQ ID NO: 7216 - RNA, 48 nt, Artificial Sequence
  Description of Artificial Sequence:  Enzymatic Nucleic Acid
ucugaaggggaggaaacucccuucaaggacaucguccgggaggugcag

SEQ ID NO: 7217 - RNA, 48 nt, Artificial Sequence
  Description of Artificial Sequence:  Enzymatic Nucleic Acid
gcccuguuggaggaaacucccuucaaggacaucguccgggugaaggca

SEQ ID NO: 7218 - RNA, 48 nt, Artificial Sequence
  Description of Artificial Sequence:  Enzymatic Nucleic Acid
ggagcgccggaggaaacucccuucaaggacaucguccggguguucuga

SEQ ID NO: 7219 - RNA, 48 nt, Artificial Sequence
  Description of Artificial Sequence:  Enzymatic Nucleic Acid
aggagcgcggaggaaacucccuucaaggacaucguccgggcuguucug

SEQ ID NO: 7220 - RNA, 48 nt, Artificial Sequence
  Description of Artificial Sequence:  Enzymatic Nucleic Acid
caggagcgggaggaaacucccuucaaggacaucguccgggccuguucu

SEQ ID NO: 7221 - RNA, 48 nt, Artificial Sequence
  Description of Artificial Sequence:  Enzymatic Nucleic Acid
cucaggagggaggaaacucccuucaaggacaucguccggggcccuguu

SEQ ID NO: 7222 - RNA, 48 nt, Artificial Sequence
  Description of Artificial Sequence:  Enzymatic Nucleic Acid
gagggucuggaggaaacucccuucaaggacaucguccgggaggagcgc

SEQ ID NO: 7223 - RNA, 48 nt, Artificial Sequence
  Description of Artificial Sequence:  Enzymatic Nucleic Acid
uggaggguggaggaaacucccuucaaggacaucguccgggucaggagc

SEQ ID NO: 7224 - RNA, 48 nt, Artificial Sequence
  Description of Artificial Sequence:  Enzymatic Nucleic Acid
aggcagcgggaggaaacucccuucaaggacaucguccggguggagggu

SEQ ID NO: 7225 - RNA, 48 nt, Artificial Sequence
  Description of Artificial Sequence:  Enzymatic Nucleic Acid
ccaggcagggaggaaacucccuucaaggacaucguccggggcuggagg

SEQ ID NO: 7226 - RNA, 48 nt, Artificial Sequence
  Description of Artificial Sequence:  Enzymatic Nucleic Acid
ccuccaggggaggaaacucccuucaaggacaucguccgggagcgcugg

SEQ ID NO: 7227 - RNA, 48 nt, Artificial Sequence
  Description of Artificial Sequence:  Enzymatic Nucleic Acid
uucuccucggaggaaacucccuucaaggacaucguccgggaggcagcg

SEQ ID NO: 7228 - RNA, 48 nt, Artificial Sequence
  Description of Artificial Sequence:  Enzymatic Nucleic Acid
auucuccuggaggaaacucccuucaaggacaucguccgggcaggcagc

SEQ ID NO: 7229 - RNA, 48 nt, Artificial Sequence
  Description of Artificial Sequence:  Enzymatic Nucleic Acid
ugauucucggaggaaacucccuucaaggacaucguccggguccaggca

SEQ ID NO: 7230 - RNA, 48 nt, Artificial Sequence
  Description of Artificial Sequence:  Enzymatic Nucleic Acid
uugauucuggaggaaacucccuucaaggacaucguccgggcuccaggc

SEQ ID NO: 7231 - RNA, 48 nt, Artificial Sequence
  Description of Artificial Sequence:  Enzymatic Nucleic Acid
ucuugauuggaggaaacucccuucaaggacaucguccggguccuccag

SEQ ID NO: 7232 - RNA, 48 nt, Artificial Sequence
  Description of Artificial Sequence:  Enzymatic Nucleic Acid
ucggagcuggaggaaacucccuucaaggacaucguccggguugauucu

SEQ ID NO: 7233 - RNA, 48 nt, Artificial Sequence
  Description of Artificial Sequence:  Enzymatic Nucleic Acid
ucucggagggaggaaacucccuucaaggacaucguccgggucuugauu

SEQ ID NO: 7234 - RNA, 48 nt, Artificial Sequence
  Description of Artificial Sequence:  Enzymatic Nucleic Acid
uggcaucuggaggaaacucccuucaaggacaucguccgggggagcucu

SEQ ID NO: 7235 - RNA, 48 nt, Artificial Sequence
  Description of Artificial Sequence:  Enzymatic Nucleic Acid
gauggcauggaggaaacucccuucaaggacaucguccgggucggagcu

SEQ ID NO: 7236 - RNA, 48 nt, Artificial Sequence
  Description of Artificial Sequence:  Enzymatic Nucleic Acid
ccggauggggaggaaacucccuucaaggacaucguccgggaucucgga

SEQ ID NO: 7237 - RNA, 48 nt, Artificial Sequence
  Description of Artificial Sequence:  Enzymatic Nucleic Acid
ugcucugcggaggaaacucccuucaaggacaucguccgggggauggca

SEQ ID NO: 7238 - RNA, 48 nt, Artificial Sequence
  Description of Artificial Sequence:  Enzymatic Nucleic Acid
uugcucugggaggaaacucccuucaaggacaucguccgggcggauggc

SEQ ID NO: 7239 - RNA, 48 nt, Artificial Sequence
  Description of Artificial Sequence:  Enzymatic Nucleic Acid
ugguugcuggaggaaacucccuucaaggacaucguccgggugccggau

SEQ ID NO: 7240 - RNA, 48 nt, Artificial Sequence
  Description of Artificial Sequence:  Enzymatic Nucleic Acid
ucugguugggaggaaacucccuucaaggacaucguccgggucugccgg

SEQ ID NO: 7241 - RNA, 48 nt, Artificial Sequence
  Description of Artificial Sequence:  Enzymatic Nucleic Acid
cgcagaauggaggaaacucccuucaaggacaucguccgggugguugcu

SEQ ID NO: 7242 - RNA, 48 nt, Artificial Sequence
  Description of Artificial Sequence:  Enzymatic Nucleic Acid
cgcucccgggaggaaacucccuucaaggacaucguccgggagaaucug

SEQ ID NO: 7243 - RNA, 48 nt, Artificial Sequence
  Description of Artificial Sequence:  Enzymatic Nucleic Acid
agcgcuccggaggaaacucccuucaaggacaucguccggggcagaauc

SEQ ID NO: 7244 - RNA, 48 nt, Artificial Sequence
  Description of Artificial Sequence:  Enzymatic Nucleic Acid
cagcgcucggaggaaacucccuucaaggacaucguccgggcgcagaau

SEQ ID NO: 7245 - RNA, 48 nt, Artificial Sequence
  Description of Artificial Sequence:  Enzymatic Nucleic Acid
gcagcgcuggaggaaacucccuucaaggacaucguccgggccgcagaa

SEQ ID NO: 7246 - RNA, 48 nt, Artificial Sequence
  Description of Artificial Sequence:  Enzymatic Nucleic Acid
ucgcagcgggaggaaacucccuucaaggacaucguccgggucccgcag

SEQ ID NO: 7247 - RNA, 48 nt, Artificial Sequence
  Description of Artificial Sequence:  Enzymatic Nucleic Acid
ccucgcagggaggaaacucccuucaaggacaucguccggggcucccgc

SEQ ID NO: 7248 - RNA, 48 nt, Artificial Sequence
  Description of Artificial Sequence:  Enzymatic Nucleic Acid
gcuccucgggaggaaacucccuucaaggacaucguccgggagcgcucc

SEQ ID NO: 7249 - RNA, 48 nt, Artificial Sequence
  Description of Artificial Sequence:  Enzymatic Nucleic Acid
aagcuccuggaggaaacucccuucaaggacaucguccggggcagcgcu

SEQ ID NO: 7250 - RNA, 48 nt, Artificial Sequence
  Description of Artificial Sequence:  Enzymatic Nucleic Acid
agaagcucggaggaaacucccuucaaggacaucguccgggucgcagcg

SEQ ID NO: 7251 - RNA, 48 nt, Artificial Sequence
  Description of Artificial Sequence:  Enzymatic Nucleic Acid
cagaagcuggaggaaacucccuucaaggacaucguccgggcucgcagc

SEQ ID NO: 7252 - RNA, 48 nt, Artificial Sequence
  Description of Artificial Sequence:  Enzymatic Nucleic Acid
ugcagaagggaggaaacucccuucaaggacaucguccggguccucgca

SEQ ID NO: 7253 - RNA, 48 nt, Artificial Sequence
  Description of Artificial Sequence:  Enzymatic Nucleic Acid
uggaaaugggaggaaacucccuucaaggacaucguccgggagaagcuc

SEQ ID NO: 7254 - RNA, 48 nt, Artificial Sequence
  Description of Artificial Sequence:  Enzymatic Nucleic Acid
cuggcuggggaggaaacucccuucaaggacaucguccggguuggaaau

SEQ ID NO: 7255 - RNA, 48 nt, Artificial Sequence
  Description of Artificial Sequence:  Enzymatic Nucleic Acid
cccucuggggaggaaacucccuucaaggacaucguccggguggcuugg

SEQ ID NO: 7256 - RNA, 48 nt, Artificial Sequence
  Description of Artificial Sequence:  Enzymatic Nucleic Acid
uccucccuggaggaaacucccuucaaggacaucguccggguggcuggc

SEQ ID NO: 7257 - RNA, 48 nt, Artificial Sequence
  Description of Artificial Sequence:  Enzymatic Nucleic Acid
ucuccuccggaggaaacucccuucaaggacaucguccgggucuggcug

SEQ ID NO: 7258 - RNA, 48 nt, Artificial Sequence
  Description of Artificial Sequence:  Enzymatic Nucleic Acid
uucuccucggaggaaacucccuucaaggacaucguccgggcucuggcu

SEQ ID NO: 7259 - RNA, 48 nt, Artificial Sequence
  Description of Artificial Sequence:  Enzymatic Nucleic Acid
cuucuccuggaggaaacucccuucaaggacaucguccgggccucuggc

SEQ ID NO: 7260 - RNA, 48 nt, Artificial Sequence
  Description of Artificial Sequence:  Enzymatic Nucleic Acid
uccuucucggaggaaacucccuucaaggacaucguccgggucccucug

SEQ ID NO: 7261 - RNA, 48 nt, Artificial Sequence
  Description of Artificial Sequence:  Enzymatic Nucleic Acid
cuccuucuggaggaaacucccuucaaggacaucguccgggcucccucu

SEQ ID NO: 7262 - RNA, 48 nt, Artificial Sequence
  Description of Artificial Sequence:  Enzymatic Nucleic Acid
aacuccuuggaggaaacucccuucaaggacaucguccggguccucccu

SEQ ID NO: 7263 - RNA, 48 nt, Artificial Sequence
  Description of Artificial Sequence:  Enzymatic Nucleic Acid
aggaacucggaggaaacucccuucaaggacaucguccggguucuccuc

SEQ ID NO: 7264 - RNA, 48 nt, Artificial Sequence
  Description of Artificial Sequence:  Enzymatic Nucleic Acid
gaggaacuggaggaaacucccuucaaggacaucguccgggcuucuccu

SEQ ID NO: 7265 - RNA, 48 nt, Artificial Sequence
  Description of Artificial Sequence:  Enzymatic Nucleic Acid
augaggaaggaggaaacucccuucaaggacaucguccggguccuucuc

SEQ ID NO: 7266 - RNA, 48 nt, Artificial Sequence
  Description of Artificial Sequence:  Enzymatic Nucleic Acid
aacuugcaggaggaaacucccuucaaggacaucguccgggaugaggaa

SEQ ID NO: 7267 - RNA, 48 nt, Artificial Sequence
  Description of Artificial Sequence:  Enzymatic Nucleic Acid
ggaacuugggaggaaacucccuucaaggacaucguccgggacaugagg

SEQ ID NO: 7268 - RNA, 48 nt, Artificial Sequence
  Description of Artificial Sequence:  Enzymatic Nucleic Acid
uccuggaaggaggaaacucccuucaaggacaucguccggguugcacau

SEQ ID NO: 7269 - RNA, 48 nt, Artificial Sequence
  Description of Artificial Sequence:  Enzymatic Nucleic Acid
cuggccucggaggaaacucccuucaaggacaucguccggguggaacuu

SEQ ID NO: 7270 - RNA, 48 nt, Artificial Sequence
  Description of Artificial Sequence:  Enzymatic Nucleic Acid
ccuggccuggaggaaacucccuucaaggacaucguccgggcuggaacu

SEQ ID NO: 7271 - RNA, 48 nt, Artificial Sequence
  Description of Artificial Sequence:  Enzymatic Nucleic Acid
uuccuggcggaggaaacucccuucaaggacaucguccggguccuggaa

SEQ ID NO: 7272 - RNA, 48 nt, Artificial Sequence
  Description of Artificial Sequence:  Enzymatic Nucleic Acid
uuuccuggggaggaaacucccuucaaggacaucguccgggcuccugga

SEQ ID NO: 7273 - RNA, 48 nt, Artificial Sequence
  Description of Artificial Sequence:  Enzymatic Nucleic Acid
ccaguuucggaggaaacucccuucaaggacaucguccggguggccucc

SEQ ID NO: 7274 - RNA, 48 nt, Artificial Sequence
  Description of Artificial Sequence:  Enzymatic Nucleic Acid
accaguuuggaggaaacucccuucaaggacaucguccgggcuggccuc

SEQ ID NO: 7275 - RNA, 48 nt, Artificial Sequence
  Description of Artificial Sequence:  Enzymatic Nucleic Acid
cucuccacggaggaaacucccuucaaggacaucguccgggaguuuccu

SEQ ID NO: 7276 - RNA, 48 nt, Artificial Sequence
  Description of Artificial Sequence:  Enzymatic Nucleic Acid
ucucuccaggaggaaacucccuucaaggacaucguccgggcaguuucc

SEQ ID NO: 7277 - RNA, 48 nt, Artificial Sequence
  Description of Artificial Sequence:  Enzymatic Nucleic Acid
agucucucggaggaaacucccuucaaggacaucguccgggaccaguuu

SEQ ID NO: 7278 - RNA, 48 nt, Artificial Sequence
  Description of Artificial Sequence:  Enzymatic Nucleic Acid
gagucucuggaggaaacucccuucaaggacaucguccgggcaccaguu

SEQ ID NO: 7279 - RNA, 48 nt, Artificial Sequence
  Description of Artificial Sequence:  Enzymatic Nucleic Acid
ccgagucuggaggaaacucccuucaaggacaucguccggguccaccag

SEQ ID NO: 7280 - RNA, 48 nt, Artificial Sequence
  Description of Artificial Sequence:  Enzymatic Nucleic Acid
ggccgaguggaggaaacucccuucaaggacaucguccgggucuccacc

SEQ ID NO: 7281 - RNA, 48 nt, Artificial Sequence
  Description of Artificial Sequence:  Enzymatic Nucleic Acid
cuccaggcggaggaaacucccuucaaggacaucguccggggagucucu

SEQ ID NO: 7282 - RNA, 48 nt, Artificial Sequence
  Description of Artificial Sequence:  Enzymatic Nucleic Acid
ucuccaggggaggaaacucccuucaaggacaucguccgggcgagucuc

SEQ ID NO: 7283 - RNA, 48 nt, Artificial Sequence
  Description of Artificial Sequence:  Enzymatic Nucleic Acid
agcuucucggaggaaacucccuucaaggacaucguccgggaggccgag

SEQ ID NO: 7284 - RNA, 48 nt, Artificial Sequence
  Description of Artificial Sequence:  Enzymatic Nucleic Acid
gagcuucuggaggaaacucccuucaaggacaucguccgggcaggccga

SEQ ID NO: 7285 - RNA, 48 nt, Artificial Sequence
  Description of Artificial Sequence:  Enzymatic Nucleic Acid
ucgagcuuggaggaaacucccuucaaggacaucguccggguccaggcc

SEQ ID NO: 7286 - RNA, 48 nt, Artificial Sequence
  Description of Artificial Sequence:  Enzymatic Nucleic Acid
agaucgagggaggaaacucccuucaaggacaucguccggguucuccag

SEQ ID NO: 7287 - RNA, 48 nt, Artificial Sequence
  Description of Artificial Sequence:  Enzymatic Nucleic Acid
cuucagauggaggaaacucccuucaaggacaucguccggggagcuucu

SEQ ID NO: 7288 - RNA, 48 nt, Artificial Sequence
  Description of Artificial Sequence:  Enzymatic Nucleic Acid
ugccucuuggaggaaacucccuucaaggacaucguccgggagaucgag

SEQ ID NO: 7289 - RNA, 48 nt, Artificial Sequence
  Description of Artificial Sequence:  Enzymatic Nucleic Acid
uucugccuggaggaaacucccuucaaggacaucguccggguucagauc

SEQ ID NO: 7290 - RNA, 48 nt, Artificial Sequence
  Description of Artificial Sequence:  Enzymatic Nucleic Acid
ccuucugcggaggaaacucccuucaaggacaucguccgggucuucaga

SEQ ID NO: 7291 - RNA, 48 nt, Artificial Sequence
  Description of Artificial Sequence:  Enzymatic Nucleic Acid
uccuucugggaggaaacucccuucaaggacaucguccgggcucuucag

SEQ ID NO: 7292 - RNA, 48 nt, Artificial Sequence
  Description of Artificial Sequence:  Enzymatic Nucleic Acid
ugcuccuuggaggaaacucccuucaaggacaucguccgggugccucuu

SEQ ID NO: 7293 - RNA, 48 nt, Artificial Sequence
  Description of Artificial Sequence:  Enzymatic Nucleic Acid
gccugcucggaggaaacucccuucaaggacaucguccggguucugccu

SEQ ID NO: 7294 - RNA, 48 nt, Artificial Sequence
  Description of Artificial Sequence:  Enzymatic Nucleic Acid
agccugcuggaggaaacucccuucaaggacaucguccgggcuucugcc

SEQ ID NO: 7295 - RNA, 48 nt, Artificial Sequence
  Description of Artificial Sequence:  Enzymatic Nucleic Acid
agagccugggaggaaacucccuucaaggacaucguccggguccuucug

SEQ ID NO: 7296 - RNA, 48 nt, Artificial Sequence
  Description of Artificial Sequence:  Enzymatic Nucleic Acid
cgcagagcggaggaaacucccuucaaggacaucguccgggugcuccuu

SEQ ID NO: 7297 - RNA, 48 nt, Artificial Sequence
  Description of Artificial Sequence:  Enzymatic Nucleic Acid
ccgcagagggaggaaacucccuucaaggacaucguccgggcugcuccu

SEQ ID NO: 7298 - RNA, 48 nt, Artificial Sequence
  Description of Artificial Sequence:  Enzymatic Nucleic Acid
accucccgggaggaaacucccuucaaggacaucguccgggagagccug

SEQ ID NO: 7299 - RNA, 48 nt, Artificial Sequence
  Description of Artificial Sequence:  Enzymatic Nucleic Acid
ccaccuccggaggaaacucccuucaaggacaucguccggggcagagcc

SEQ ID NO: 7300 - RNA, 48 nt, Artificial Sequence
  Description of Artificial Sequence:  Enzymatic Nucleic Acid
uccaccucggaggaaacucccuucaaggacaucguccgggcgcagagc

SEQ ID NO: 7301 - RNA, 48 nt, Artificial Sequence
  Description of Artificial Sequence:  Enzymatic Nucleic Acid
cuccaccuggaggaaacucccuucaaggacaucguccgggccgcagag

SEQ ID NO: 7302 - RNA, 48 nt, Artificial Sequence
  Description of Artificial Sequence:  Enzymatic Nucleic Acid
ugcuccacggaggaaacucccuucaaggacaucguccgggucccgcag

SEQ ID NO: 7303 - RNA, 48 nt, Artificial Sequence
  Description of Artificial Sequence:  Enzymatic Nucleic Acid
gugcuccaggaggaaacucccuucaaggacaucguccgggcucccgca

SEQ ID NO: 7304 - RNA, 48 nt, Artificial Sequence
  Description of Artificial Sequence:  Enzymatic Nucleic Acid
aggugcucggaggaaacucccuucaaggacaucguccgggaccucccg

SEQ ID NO: 7305 - RNA, 48 nt, Artificial Sequence
  Description of Artificial Sequence:  Enzymatic Nucleic Acid
caggugcuggaggaaacucccuucaaggacaucguccgggcaccuccc

SEQ ID NO: 7306 - RNA, 48 nt, Artificial Sequence
  Description of Artificial Sequence:  Enzymatic Nucleic Acid
uucaggugggaggaaacucccuucaaggacaucguccggguccaccuc

SEQ ID NO: 7307 - RNA, 48 nt, Artificial Sequence
  Description of Artificial Sequence:  Enzymatic Nucleic Acid
caucucuuggaggaaacucccuucaaggacaucguccgggaggugcuc

SEQ ID NO: 7308 - RNA, 48 nt, Artificial Sequence
  Description of Artificial Sequence:  Enzymatic Nucleic Acid
uggcaucuggaggaaacucccuucaaggacaucguccggguucaggug

SEQ ID NO: 7309 - RNA, 48 nt, Artificial Sequence
  Description of Artificial Sequence:  Enzymatic Nucleic Acid
gcuggcauggaggaaacucccuucaaggacaucguccgggucuucagg

SEQ ID NO: 7310 - RNA, 48 nt, Artificial Sequence
  Description of Artificial Sequence:  Enzymatic Nucleic Acid
gcugcuggggaggaaacucccuucaaggacaucguccgggaucucuuc

SEQ ID NO: 7311 - RNA, 48 nt, Artificial Sequence
  Description of Artificial Sequence:  Enzymatic Nucleic Acid
aucugcugggaggaaacucccuucaaggacaucguccggguggcaucu

SEQ ID NO: 7312 - RNA, 48 nt, Artificial Sequence
  Description of Artificial Sequence:  Enzymatic Nucleic Acid
gccaucugggaggaaacucccuucaaggacaucguccgggugcuggca

SEQ ID NO: 7313 - RNA, 48 nt, Artificial Sequence
  Description of Artificial Sequence:  Enzymatic Nucleic Acid
ucagccauggaggaaacucccuucaaggacaucguccgggugcugcug

SEQ ID NO: 7314 - RNA, 48 nt, Artificial Sequence
  Description of Artificial Sequence:  Enzymatic Nucleic Acid
uccucagcggaggaaacucccuucaaggacaucguccgggaucugcug

SEQ ID NO: 7315 - RNA, 48 nt, Artificial Sequence
  Description of Artificial Sequence:  Enzymatic Nucleic Acid
guccucagggaggaaacucccuucaaggacaucguccgggcaucugcu

SEQ ID NO: 7316 - RNA, 48 nt, Artificial Sequence
  Description of Artificial Sequence:  Enzymatic Nucleic Acid
cuuguccuggaggaaacucccuucaaggacaucguccgggagccaucu

SEQ ID NO: 7317 - RNA, 48 nt, Artificial Sequence
  Description of Artificial Sequence:  Enzymatic Nucleic Acid
gccuugucggaggaaacucccuucaaggacaucguccgggucagccau

SEQ ID NO: 7318 - RNA, 48 nt, Artificial Sequence
  Description of Artificial Sequence:  Enzymatic Nucleic Acid
ggccuuguggaggaaacucccuucaaggacaucguccgggcucagcca

SEQ ID NO: 7319 - RNA, 48 nt, Artificial Sequence
  Description of Artificial Sequence:  Enzymatic Nucleic Acid
acagaggcggaggaaacucccuucaaggacaucguccggguuguccuc

SEQ ID NO: 7320 - RNA, 48 nt, Artificial Sequence
  Description of Artificial Sequence:  Enzymatic Nucleic Acid
cacagaggggaggaaacucccuucaaggacaucguccgggcuuguccu

SEQ ID NO: 7321 - RNA, 48 nt, Artificial Sequence
  Description of Artificial Sequence:  Enzymatic Nucleic Acid
ggcuuucaggaggaaacucccuucaaggacaucguccgggagaggccu

SEQ ID NO: 7322 - RNA, 48 nt, Artificial Sequence
  Description of Artificial Sequence:  Enzymatic Nucleic Acid
ugggcuuuggaggaaacucccuucaaggacaucguccgggacagaggc

SEQ ID NO: 7323 - RNA, 48 nt, Artificial Sequence
  Description of Artificial Sequence:  Enzymatic Nucleic Acid
caccugggggaggaaacucccuucaaggacaucguccggguuucacag

SEQ ID NO: 7324 - RNA, 48 nt, Artificial Sequence
  Description of Artificial Sequence:  Enzymatic Nucleic Acid
gacgucacggaggaaacucccuucaaggacaucguccgggugggcuuu

SEQ ID NO: 7325 - RNA, 48 nt, Artificial Sequence
  Description of Artificial Sequence:  Enzymatic Nucleic Acid
ggacgucaggaggaaacucccuucaaggacaucguccgggcugggcuu

SEQ ID NO: 7326 - RNA, 48 nt, Artificial Sequence
  Description of Artificial Sequence:  Enzymatic Nucleic Acid
aaggacguggaggaaacucccuucaaggacaucguccgggaccugggc

SEQ ID NO: 7327 - RNA, 48 nt, Artificial Sequence
  Description of Artificial Sequence:  Enzymatic Nucleic Acid
agcaaggaggaggaaacucccuucaaggacaucguccggggucaccug

SEQ ID NO: 7328 - RNA, 48 nt, Artificial Sequence
  Description of Artificial Sequence:  Enzymatic Nucleic Acid
uccccgagggaggaaacucccuucaaggacaucguccgggaaggacgu

SEQ ID NO: 7329 - RNA, 48 nt, Artificial Sequence
  Description of Artificial Sequence:  Enzymatic Nucleic Acid
cagcucccggaggaaacucccuucaaggacaucguccggggagcaagg

SEQ ID NO: 7330 - RNA, 48 nt, Artificial Sequence
  Description of Artificial Sequence:  Enzymatic Nucleic Acid
gcagcuccggaggaaacucccuucaaggacaucguccgggcgagcaag

SEQ ID NO: 7331 - RNA, 48 nt, Artificial Sequence
  Description of Artificial Sequence:  Enzymatic Nucleic Acid
ugcagcucggaggaaacucccuucaaggacaucguccgggccgagcaa

SEQ ID NO: 7332 - RNA, 48 nt, Artificial Sequence
  Description of Artificial Sequence:  Enzymatic Nucleic Acid
cugcagcuggaggaaacucccuucaaggacaucguccgggcccgagca

SEQ ID NO: 7333 - RNA, 48 nt, Artificial Sequence
  Description of Artificial Sequence:  Enzymatic Nucleic Acid
uccugcagggaggaaacucccuucaaggacaucguccggguccccgag

SEQ ID NO: 7334 - RNA, 48 nt, Artificial Sequence
  Description of Artificial Sequence:  Enzymatic Nucleic Acid
cucuccugggaggaaacucccuucaaggacaucguccgggagcucccc

SEQ ID NO: 7335 - RNA, 48 nt, Artificial Sequence
  Description of Artificial Sequence:  Enzymatic Nucleic Acid
uggcucucggaggaaacucccuucaaggacaucguccgggugcagcuc

SEQ ID NO: 7336 - RNA, 48 nt, Artificial Sequence
  Description of Artificial Sequence:  Enzymatic Nucleic Acid
cuggcucuggaggaaacucccuucaaggacaucguccgggcugcagcu

SEQ ID NO: 7337 - RNA, 48 nt, Artificial Sequence
  Description of Artificial Sequence:  Enzymatic Nucleic Acid
cucuggcuggaggaaacucccuucaaggacaucguccggguccugcag

SEQ ID NO: 7338 - RNA, 48 nt, Artificial Sequence
  Description of Artificial Sequence:  Enzymatic Nucleic Acid
gacucuggggaggaaacucccuucaaggacaucguccgggucuccugc

SEQ ID NO: 7339 - RNA, 48 nt, Artificial Sequence
  Description of Artificial Sequence:  Enzymatic Nucleic Acid
aagcgacuggaggaaacucccuucaaggacaucguccggguggcucuc

SEQ ID NO: 7340 - RNA, 48 nt, Artificial Sequence
  Description of Artificial Sequence:  Enzymatic Nucleic Acid
ccaagcgaggaggaaacucccuucaaggacaucguccgggucuggcuc

SEQ ID NO: 7341 - RNA, 48 nt, Artificial Sequence
  Description of Artificial Sequence:  Enzymatic Nucleic Acid
ccuccaagggaggaaacucccuucaaggacaucguccggggacucugg

SEQ ID NO: 7342 - RNA, 48 nt, Artificial Sequence
  Description of Artificial Sequence:  Enzymatic Nucleic Acid
gcagccucggaggaaacucccuucaaggacaucguccgggaagcgacu

SEQ ID NO: 7343 - RNA, 48 nt, Artificial Sequence
  Description of Artificial Sequence:  Enzymatic Nucleic Acid
ggcagccuggaggaaacucccuucaaggacaucguccgggcaagcgac

SEQ ID NO: 7344 - RNA, 48 nt, Artificial Sequence
  Description of Artificial Sequence:  Enzymatic Nucleic Acid
guggcagcggaggaaacucccuucaaggacaucguccggguccaagcg

SEQ ID NO: 7345 - RNA, 48 nt, Artificial Sequence
  Description of Artificial Sequence:  Enzymatic Nucleic Acid
aguggcagggaggaaacucccuucaaggacaucguccgggcuccaagc

SEQ ID NO: 7346 - RNA, 48 nt, Artificial Sequence
  Description of Artificial Sequence:  Enzymatic Nucleic Acid
cuuaguggggaggaaacucccuucaaggacaucguccgggagccucca

SEQ ID NO: 7347 - RNA, 48 nt, Artificial Sequence
  Description of Artificial Sequence:  Enzymatic Nucleic Acid
uggcauucggaggaaacucccuucaaggacaucguccggguuaguggc

SEQ ID NO: 7348 - RNA, 48 nt, Artificial Sequence
  Description of Artificial Sequence:  Enzymatic Nucleic Acid
cuggcauuggaggaaacucccuucaaggacaucguccgggcuuagugg

SEQ ID NO: 7349 - RNA, 48 nt, Artificial Sequence
  Description of Artificial Sequence:  Enzymatic Nucleic Acid
gagccuggggaggaaacucccuucaaggacaucguccgggauuccuua

SEQ ID NO: 7350 - RNA, 48 nt, Artificial Sequence
  Description of Artificial Sequence:  Enzymatic Nucleic Acid
uccagagcggaggaaacucccuucaaggacaucguccggguggcauuc

SEQ ID NO: 7351 - RNA, 48 nt, Artificial Sequence
  Description of Artificial Sequence:  Enzymatic Nucleic Acid
cuccagagggaggaaacucccuucaaggacaucguccgggcuggcauu

SEQ ID NO: 7352 - RNA, 48 nt, Artificial Sequence
  Description of Artificial Sequence:  Enzymatic Nucleic Acid
cgacccucggaggaaacucccuucaaggacaucguccgggagagccug

SEQ ID NO: 7353 - RNA, 48 nt, Artificial Sequence
  Description of Artificial Sequence:  Enzymatic Nucleic Acid
ccgacccuggaggaaacucccuucaaggacaucguccgggcagagccu

SEQ ID NO: 7354 - RNA, 48 nt, Artificial Sequence
  Description of Artificial Sequence:  Enzymatic Nucleic Acid
gcccgaccggaggaaacucccuucaaggacaucguccggguccagagc

SEQ ID NO: 7355 - RNA, 48 nt, Artificial Sequence
  Description of Artificial Sequence:  Enzymatic Nucleic Acid
ggcccgacggaggaaacucccuucaaggacaucguccgggcuccagag

SEQ ID NO: 7356 - RNA, 48 nt, Artificial Sequence
  Description of Artificial Sequence:  Enzymatic Nucleic Acid
gggcccgaggaggaaacucccuucaaggacaucguccgggccuccaga

SEQ ID NO: 7357 - RNA, 48 nt, Artificial Sequence
  Description of Artificial Sequence:  Enzymatic Nucleic Acid
cccgggccggaggaaacucccuucaaggacaucguccggggacccucc

SEQ ID NO: 7358 - RNA, 48 nt, Artificial Sequence
  Description of Artificial Sequence:  Enzymatic Nucleic Acid
gcccgggcggaggaaacucccuucaaggacaucguccgggcgacccuc

SEQ ID NO: 7359 - RNA, 48 nt, Artificial Sequence
  Description of Artificial Sequence:  Enzymatic Nucleic Acid
cgcccgggggaggaaacucccuucaaggacaucguccgggccgacccu

SEQ ID NO: 7360 - RNA, 48 nt, Artificial Sequence
  Description of Artificial Sequence:  Enzymatic Nucleic Acid
uggccgccggaggaaacucccuucaaggacaucguccggggggcccga

SEQ ID NO: 7361 - RNA, 48 nt, Artificial Sequence
  Description of Artificial Sequence:  Enzymatic Nucleic Acid
cuggccgcggaggaaacucccuucaaggacaucguccgggcgggcccg

SEQ ID NO: 7362 - RNA, 48 nt, Artificial Sequence
  Description of Artificial Sequence:  Enzymatic Nucleic Acid
gcuggccgggaggaaacucccuucaaggacaucguccgggccgggccc

SEQ ID NO: 7363 - RNA, 48 nt, Artificial Sequence
  Description of Artificial Sequence:  Enzymatic Nucleic Acid
ucgcuggcggaggaaacucccuucaaggacaucguccggggcccgggc

SEQ ID NO: 7364 - RNA, 48 nt, Artificial Sequence
  Description of Artificial Sequence:  Enzymatic Nucleic Acid
cucgcuggggaggaaacucccuucaaggacaucguccgggcgcccggg

SEQ ID NO: 7365 - RNA, 48 nt, Artificial Sequence
  Description of Artificial Sequence:  Enzymatic Nucleic Acid
ccugcucgggaggaaacucccuucaaggacaucguccggguggccgcc

SEQ ID NO: 7366 - RNA, 48 nt, Artificial Sequence
  Description of Artificial Sequence:  Enzymatic Nucleic Acid
cgccugcuggaggaaacucccuucaaggacaucguccggggcuggccg

SEQ ID NO: 7367 - RNA, 48 nt, Artificial Sequence
  Description of Artificial Sequence:  Enzymatic Nucleic Acid
cgcgccugggaggaaacucccuucaaggacaucguccgggucgcuggc

SEQ ID NO: 7368 - RNA, 48 nt, Artificial Sequence
  Description of Artificial Sequence:  Enzymatic Nucleic Acid
ugccgcgcggaggaaacucccuucaaggacaucguccgggugcucgcu

SEQ ID NO: 7369 - RNA, 48 nt, Artificial Sequence
  Description of Artificial Sequence:  Enzymatic Nucleic Acid
cugccgcgggaggaaacucccuucaaggacaucguccgggcugcucgc

SEQ ID NO: 7370 - RNA, 48 nt, Artificial Sequence
  Description of Artificial Sequence:  Enzymatic Nucleic Acid
agcugccgggaggaaacucccuucaaggacaucguccggggccugcuc

SEQ ID NO: 7371 - RNA, 48 nt, Artificial Sequence
  Description of Artificial Sequence:  Enzymatic Nucleic Acid
ccagcugcggaggaaacucccuucaaggacaucguccggggcgccugc

SEQ ID NO: 7372 - RNA, 48 nt, Artificial Sequence
  Description of Artificial Sequence:  Enzymatic Nucleic Acid
uccagcugggaggaaacucccuucaaggacaucguccgggcgcgccug

SEQ ID NO: 7373 - RNA, 48 nt, Artificial Sequence
  Description of Artificial Sequence:  Enzymatic Nucleic Acid
cucuccagggaggaaacucccuucaaggacaucguccgggugccgcgc

SEQ ID NO: 7374 - RNA, 48 nt, Artificial Sequence
  Description of Artificial Sequence:  Enzymatic Nucleic Acid
ucacucucggaggaaacucccuucaaggacaucguccgggagcugccg

SEQ ID NO: 7375 - RNA, 48 nt, Artificial Sequence
  Description of Artificial Sequence:  Enzymatic Nucleic Acid
cucacucuggaggaaacucccuucaaggacaucguccgggcagcugcc

SEQ ID NO: 7376 - RNA, 48 nt, Artificial Sequence
  Description of Artificial Sequence:  Enzymatic Nucleic Acid
cgcucacuggaggaaacucccuucaaggacaucguccggguccagcug

SEQ ID NO: 7377 - RNA, 48 nt, Artificial Sequence
  Description of Artificial Sequence:  Enzymatic Nucleic Acid
cgcgcucaggaggaaacucccuucaaggacaucguccgggucuccagc

SEQ ID NO: 7378 - RNA, 48 nt, Artificial Sequence
  Description of Artificial Sequence:  Enzymatic Nucleic Acid
cucgcgcuggaggaaacucccuucaaggacaucguccgggacucucca

SEQ ID NO: 7379 - RNA, 48 nt, Artificial Sequence
  Description of Artificial Sequence:  Enzymatic Nucleic Acid
gccucgcgggaggaaacucccuucaaggacaucguccgggucacucuc

SEQ ID NO: 7380 - RNA, 48 nt, Artificial Sequence
  Description of Artificial Sequence:  Enzymatic Nucleic Acid
gcgccucgggaggaaacucccuucaaggacaucguccggggcucacuc

SEQ ID NO: 7381 - RNA, 48 nt, Artificial Sequence
  Description of Artificial Sequence:  Enzymatic Nucleic Acid
cagcgccuggaggaaacucccuucaaggacaucguccggggcgcucac

SEQ ID NO: 7382 - RNA, 48 nt, Artificial Sequence
  Description of Artificial Sequence:  Enzymatic Nucleic Acid
ugcagcgcggaggaaacucccuucaaggacaucguccgggucgcgcuc

SEQ ID NO: 7383 - RNA, 48 nt, Artificial Sequence
  Description of Artificial Sequence:  Enzymatic Nucleic Acid
cugcagcgggaggaaacucccuucaaggacaucguccgggcucgcgcu

SEQ ID NO: 7384 - RNA, 48 nt, Artificial Sequence
  Description of Artificial Sequence:  Enzymatic Nucleic Acid
ugcugcagggaggaaacucccuucaaggacaucguccggggccucgcg

SEQ ID NO: 7385 - RNA, 48 nt, Artificial Sequence
  Description of Artificial Sequence:  Enzymatic Nucleic Acid
ugcugcugggaggaaacucccuucaaggacaucguccgggagcgccuc

SEQ ID NO: 7386 - RNA, 48 nt, Artificial Sequence
  Description of Artificial Sequence:  Enzymatic Nucleic Acid
ugcugcugggaggaaacucccuucaaggacaucguccgggugcagcgc

SEQ ID NO: 7387 - RNA, 48 nt, Artificial Sequence
  Description of Artificial Sequence:  Enzymatic Nucleic Acid
cugugcugggaggaaacucccuucaaggacaucguccgggugcugcag

SEQ ID NO: 7388 - RNA, 48 nt, Artificial Sequence
  Description of Artificial Sequence:  Enzymatic Nucleic Acid
acgcugugggaggaaacucccuucaaggacaucguccgggugcugcug

SEQ ID NO: 7389 - RNA, 48 nt, Artificial Sequence
  Description of Artificial Sequence:  Enzymatic Nucleic Acid
ccugcacgggaggaaacucccuucaaggacaucguccgggugugcugc

SEQ ID NO: 7390 - RNA, 48 nt, Artificial Sequence
  Description of Artificial Sequence:  Enzymatic Nucleic Acid
caccugcaggaggaaacucccuucaaggacaucguccggggcugugcu

SEQ ID NO: 7391 - RNA, 48 nt, Artificial Sequence
  Description of Artificial Sequence:  Enzymatic Nucleic Acid
uccaccugggaggaaacucccuucaaggacaucguccgggacgcugug

SEQ ID NO: 7392 - RNA, 48 nt, Artificial Sequence
  Description of Artificial Sequence:  Enzymatic Nucleic Acid
ugguccacggaggaaacucccuucaaggacaucguccgggugcacgcu

SEQ ID NO: 7393 - RNA, 48 nt, Artificial Sequence
  Description of Artificial Sequence:  Enzymatic Nucleic Acid
cugguccaggaggaaacucccuucaaggacaucguccgggcugcacgc

SEQ ID NO: 7394 - RNA, 48 nt, Artificial Sequence
  Description of Artificial Sequence:  Enzymatic Nucleic Acid
agcuggucggaggaaacucccuucaaggacaucguccgggaccugcac

SEQ ID NO: 7395 - RNA, 48 nt, Artificial Sequence
  Description of Artificial Sequence:  Enzymatic Nucleic Acid
cagcugguggaggaaacucccuucaaggacaucguccgggcaccugca

SEQ ID NO: 7396 - RNA, 48 nt, Artificial Sequence
  Description of Artificial Sequence:  Enzymatic Nucleic Acid
augcgcagggaggaaacucccuucaaggacaucguccgggugguccac

SEQ ID NO: 7397 - RNA, 48 nt, Artificial Sequence
  Description of Artificial Sequence:  Enzymatic Nucleic Acid
ugcaugcgggaggaaacucccuucaaggacaucguccgggagcugguc

SEQ ID NO: 7398 - RNA, 48 nt, Artificial Sequence
  Description of Artificial Sequence:  Enzymatic Nucleic Acid
ccugcaugggaggaaacucccuucaaggacaucguccggggcagcugg

SEQ ID NO: 7399 - RNA, 48 nt, Artificial Sequence
  Description of Artificial Sequence:  Enzymatic Nucleic Acid
uggcccugggaggaaacucccuucaaggacaucguccgggaugcgcag

SEQ ID NO: 7400 - RNA, 48 nt, Artificial Sequence
  Description of Artificial Sequence:  Enzymatic Nucleic Acid
cucuggccggaggaaacucccuucaaggacaucguccgggugcaugcg

SEQ ID NO: 7401 - RNA, 48 nt, Artificial Sequence
  Description of Artificial Sequence:  Enzymatic Nucleic Acid
gcucuggcggaggaaacucccuucaaggacaucguccgggcugcaugc

SEQ ID NO: 7402 - RNA, 48 nt, Artificial Sequence
  Description of Artificial Sequence:  Enzymatic Nucleic Acid
cgcucuggggaggaaacucccuucaaggacaucguccgggccugcaug

SEQ ID NO: 7403 - RNA, 48 nt, Artificial Sequence
  Description of Artificial Sequence:  Enzymatic Nucleic Acid
uccacgcuggaggaaacucccuucaaggacaucguccggguggcccug

SEQ ID NO: 7404 - RNA, 48 nt, Artificial Sequence
  Description of Artificial Sequence:  Enzymatic Nucleic Acid
ccuccacgggaggaaacucccuucaaggacaucguccgggucuggccc

SEQ ID NO: 7405 - RNA, 48 nt, Artificial Sequence
  Description of Artificial Sequence:  Enzymatic Nucleic Acid
ggccuccaggaggaaacucccuucaaggacaucguccggggcucuggc

SEQ ID NO: 7406 - RNA, 48 nt, Artificial Sequence
  Description of Artificial Sequence:  Enzymatic Nucleic Acid
gcggccucggaggaaacucccuucaaggacaucguccgggacgcucug

SEQ ID NO: 7407 - RNA, 48 nt, Artificial Sequence
  Description of Artificial Sequence:  Enzymatic Nucleic Acid
cgcggccuggaggaaacucccuucaaggacaucguccgggcacgcucu

SEQ ID NO: 7408 - RNA, 48 nt, Artificial Sequence
  Description of Artificial Sequence:  Enzymatic Nucleic Acid
agcgcggcggaggaaacucccuucaaggacaucguccggguccacgcu

SEQ ID NO: 7409 - RNA, 48 nt, Artificial Sequence
  Description of Artificial Sequence:  Enzymatic Nucleic Acid
gagcgcggggaggaaacucccuucaaggacaucguccgggcuccacgc

SEQ ID NO: 7410 - RNA, 48 nt, Artificial Sequence
  Description of Artificial Sequence:  Enzymatic Nucleic Acid
gcggagcgggaggaaacucccuucaaggacaucguccgggggccucca

SEQ ID NO: 7411 - RNA, 48 nt, Artificial Sequence
  Description of Artificial Sequence:  Enzymatic Nucleic Acid
augcggagggaggaaacucccuucaaggacaucguccggggcggccuc

SEQ ID NO: 7412 - RNA, 48 nt, Artificial Sequence
  Description of Artificial Sequence:  Enzymatic Nucleic Acid
gcuccaugggaggaaacucccuucaaggacaucguccgggggagcgcg

SEQ ID NO: 7413 - RNA, 48 nt, Artificial Sequence
  Description of Artificial Sequence:  Enzymatic Nucleic Acid
uggcgcucggaggaaacucccuucaaggacaucguccgggaugcggag

SEQ ID NO: 7414 - RNA, 48 nt, Artificial Sequence
  Description of Artificial Sequence:  Enzymatic Nucleic Acid
cuggcgcuggaggaaacucccuucaaggacaucguccgggcaugcgga

SEQ ID NO: 7415 - RNA, 48 nt, Artificial Sequence
  Description of Artificial Sequence:  Enzymatic Nucleic Acid
gccuggcgggaggaaacucccuucaaggacaucguccggguccaugcg

SEQ ID NO: 7416 - RNA, 48 nt, Artificial Sequence
  Description of Artificial Sequence:  Enzymatic Nucleic Acid
cggccuggggaggaaacucccuucaaggacaucguccggggcuccaug

SEQ ID NO: 7417 - RNA, 48 nt, Artificial Sequence
  Description of Artificial Sequence:  Enzymatic Nucleic Acid
gaggcggcggaggaaacucccuucaaggacaucguccggguggcgcuc

SEQ ID NO: 7418 - RNA, 48 nt, Artificial Sequence
  Description of Artificial Sequence:  Enzymatic Nucleic Acid
cgaggcggggaggaaacucccuucaaggacaucguccgggcuggcgcu

SEQ ID NO: 7419 - RNA, 48 nt, Artificial Sequence
  Description of Artificial Sequence:  Enzymatic Nucleic Acid
cuccgaggggaggaaacucccuucaaggacaucguccgggggccuggc

SEQ ID NO: 7420 - RNA, 48 nt, Artificial Sequence
  Description of Artificial Sequence:  Enzymatic Nucleic Acid
uucuccucggaggaaacucccuucaaggacaucguccggggaggcggc

SEQ ID NO: 7421 - RNA, 48 nt, Artificial Sequence
  Description of Artificial Sequence:  Enzymatic Nucleic Acid
cuucuccuggaggaaacucccuucaaggacaucguccgggcgaggcgg

SEQ ID NO: 7422 - RNA, 48 nt, Artificial Sequence
  Description of Artificial Sequence:  Enzymatic Nucleic Acid
cucuucucggaggaaacucccuucaaggacaucguccggguccgaggc

SEQ ID NO: 7423 - RNA, 48 nt, Artificial Sequence
  Description of Artificial Sequence:  Enzymatic Nucleic Acid
ccucuucuggaggaaacucccuucaaggacaucguccgggcuccgagg

SEQ ID NO: 7424 - RNA, 48 nt, Artificial Sequence
  Description of Artificial Sequence:  Enzymatic Nucleic Acid
uuccucuuggaggaaacucccuucaaggacaucguccggguccuccga

SEQ ID NO: 7425 - RNA, 48 nt, Artificial Sequence
  Description of Artificial Sequence:  Enzymatic Nucleic Acid
agcuuccuggaggaaacucccuucaaggacaucguccggguucuccuc

SEQ ID NO: 7426 - RNA, 48 nt, Artificial Sequence
  Description of Artificial Sequence:  Enzymatic Nucleic Acid
ccagcuucggaggaaacucccuucaaggacaucguccgggucuucucc

SEQ ID NO: 7427 - RNA, 48 nt, Artificial Sequence
  Description of Artificial Sequence:  Enzymatic Nucleic Acid
gccagcuuggaggaaacucccuucaaggacaucguccgggcucuucuc

SEQ ID NO: 7428 - RNA, 48 nt, Artificial Sequence
  Description of Artificial Sequence:  Enzymatic Nucleic Acid
ugggccagggaggaaacucccuucaaggacaucguccggguuccucuu

SEQ ID NO: 7429 - RNA, 48 nt, Artificial Sequence
  Description of Artificial Sequence:  Enzymatic Nucleic Acid
aacugggcggaggaaacucccuucaaggacaucguccgggagcuuccu

SEQ ID NO: 7430 - RNA, 48 nt, Artificial Sequence
  Description of Artificial Sequence:  Enzymatic Nucleic Acid
caacugggggaggaaacucccuucaaggacaucguccgggcagcuucc

SEQ ID NO: 7431 - RNA, 48 nt, Artificial Sequence
  Description of Artificial Sequence:  Enzymatic Nucleic Acid
accugcaaggaggaaacucccuucaaggacaucguccgggugggccag

SEQ ID NO: 7432 - RNA, 48 nt, Artificial Sequence
  Description of Artificial Sequence:  Enzymatic Nucleic Acid
gccaccugggaggaaacucccuucaaggacaucguccgggaacugggc

SEQ ID NO: 7433 - RNA, 48 nt, Artificial Sequence
  Description of Artificial Sequence:  Enzymatic Nucleic Acid
uaggccacggaggaaacucccuucaaggacaucguccgggugcaacug

SEQ ID NO: 7434 - RNA, 48 nt, Artificial Sequence
  Description of Artificial Sequence:  Enzymatic Nucleic Acid
auaggccaggaggaaacucccuucaaggacaucguccgggcugcaacu

SEQ ID NO: 7435 - RNA, 48 nt, Artificial Sequence
  Description of Artificial Sequence:  Enzymatic Nucleic Acid
ugauaggcggaggaaacucccuucaaggacaucguccgggaccugcaa

SEQ ID NO: 7436 - RNA, 48 nt, Artificial Sequence
  Description of Artificial Sequence:  Enzymatic Nucleic Acid
gugauaggggaggaaacucccuucaaggacaucguccgggcaccugca

SEQ ID NO: 7437 - RNA, 48 nt, Artificial Sequence
  Description of Artificial Sequence:  Enzymatic Nucleic Acid
uggaagagggaggaaacucccuucaaggacaucguccggguggugaua

SEQ ID NO: 7438 - RNA, 48 nt, Artificial Sequence
  Description of Artificial Sequence:  Enzymatic Nucleic Acid
gucguauuggaggaaacucccuucaaggacaucguccggguuggaaga

SEQ ID NO: 7439 - RNA, 48 nt, Artificial Sequence
  Description of Artificial Sequence:  Enzymatic Nucleic Acid
gugguuguggaggaaacucccuucaaggacaucguccgggguauucuu

SEQ ID NO: 7440 - RNA, 48 nt, Artificial Sequence
  Description of Artificial Sequence:  Enzymatic Nucleic Acid
acgcugcuggaggaaacucccuucaaggacaucguccggguugaugug

SEQ ID NO: 7441 - RNA, 48 nt, Artificial Sequence
  Description of Artificial Sequence:  Enzymatic Nucleic Acid
ccacgcugggaggaaacucccuucaaggacaucguccgggucuugaug

SEQ ID NO: 7442 - RNA, 48 nt, Artificial Sequence
  Description of Artificial Sequence:  Enzymatic Nucleic Acid
ccaccacgggaggaaacucccuucaaggacaucguccgggugcucuug

SEQ ID NO: 7443 - RNA, 48 nt, Artificial Sequence
  Description of Artificial Sequence:  Enzymatic Nucleic Acid
gcccaccaggaggaaacucccuucaaggacaucguccggggcugcucu

SEQ ID NO: 7444 - RNA, 48 nt, Artificial Sequence
  Description of Artificial Sequence:  Enzymatic Nucleic Acid
cugcccacggaggaaacucccuucaaggacaucguccgggacgcugcu

SEQ ID NO: 7445 - RNA, 48 nt, Artificial Sequence
  Description of Artificial Sequence:  Enzymatic Nucleic Acid
acugcccaggaggaaacucccuucaaggacaucguccgggcacgcugc

SEQ ID NO: 7446 - RNA, 48 nt, Artificial Sequence
  Description of Artificial Sequence:  Enzymatic Nucleic Acid
ucacugccggaggaaacucccuucaaggacaucguccgggaccacgcu

SEQ ID NO: 7447 - RNA, 48 nt, Artificial Sequence
  Description of Artificial Sequence:  Enzymatic Nucleic Acid
cucacugcggaggaaacucccuucaaggacaucguccgggcaccacgc

SEQ ID NO: 7448 - RNA, 48 nt, Artificial Sequence
  Description of Artificial Sequence:  Enzymatic Nucleic Acid
gcucacugggaggaaacucccuucaaggacaucguccgggccaccacg

SEQ ID NO: 7449 - RNA, 48 nt, Artificial Sequence
  Description of Artificial Sequence:  Enzymatic Nucleic Acid
uccgcucaggaggaaacucccuucaaggacaucguccgggugcccacc

SEQ ID NO: 7450 - RNA, 48 nt, Artificial Sequence
  Description of Artificial Sequence:  Enzymatic Nucleic Acid
cuuccgcuggaggaaacucccuucaaggacaucguccgggacugccca

SEQ ID NO: 7451 - RNA, 48 nt, Artificial Sequence
  Description of Artificial Sequence:  Enzymatic Nucleic Acid
cgcuuccgggaggaaacucccuucaaggacaucguccgggucacugcc

SEQ ID NO: 7452 - RNA, 48 nt, Artificial Sequence
  Description of Artificial Sequence:  Enzymatic Nucleic Acid
cucgcuucggaggaaacucccuucaaggacaucguccggggcucacug

SEQ ID NO: 7453 - RNA, 48 nt, Artificial Sequence
  Description of Artificial Sequence:  Enzymatic Nucleic Acid
ccucgcuuggaggaaacucccuucaaggacaucguccgggcgcucacu

SEQ ID NO: 7454 - RNA, 48 nt, Artificial Sequence
  Description of Artificial Sequence:  Enzymatic Nucleic Acid
auuccucgggaggaaacucccuucaaggacaucguccggguuccgcuc

SEQ ID NO: 7455 - RNA, 48 nt, Artificial Sequence
  Description of Artificial Sequence:  Enzymatic Nucleic Acid
gcauuccuggaggaaacucccuucaaggacaucguccggggcuuccgc

SEQ ID NO: 7456 - RNA, 48 nt, Artificial Sequence
  Description of Artificial Sequence:  Enzymatic Nucleic Acid
cugcauucggaggaaacucccuucaaggacaucguccgggucgcuucc

SEQ ID NO: 7457 - RNA, 48 nt, Artificial Sequence
  Description of Artificial Sequence:  Enzymatic Nucleic Acid
gcugcauuggaggaaacucccuucaaggacaucguccgggcucgcuuc

SEQ ID NO: 7458 - RNA, 48 nt, Artificial Sequence
  Description of Artificial Sequence:  Enzymatic Nucleic Acid
uccagcugggaggaaacucccuucaaggacaucguccgggauuccucg

SEQ ID NO: 7459 - RNA, 48 nt, Artificial Sequence
  Description of Artificial Sequence:  Enzymatic Nucleic Acid
ucuuccagggaggaaacucccuucaaggacaucguccgggugcauucc

SEQ ID NO: 7460 - RNA, 48 nt, Artificial Sequence
  Description of Artificial Sequence:  Enzymatic Nucleic Acid
agaucuucggaggaaacucccuucaaggacaucguccgggagcugcau

SEQ ID NO: 7461 - RNA, 48 nt, Artificial Sequence
  Description of Artificial Sequence:  Enzymatic Nucleic Acid
gagaucuuggaggaaacucccuucaaggacaucguccgggcagcugca

SEQ ID NO: 7462 - RNA, 48 nt, Artificial Sequence
  Description of Artificial Sequence:  Enzymatic Nucleic Acid
uuugagauggaggaaacucccuucaaggacaucguccggguuccagcu

SEQ ID NO: 7463 - RNA, 48 nt, Artificial Sequence
  Description of Artificial Sequence:  Enzymatic Nucleic Acid
uggagcugggaggaaacucccuucaaggacaucguccggguguuugag

SEQ ID NO: 7464 - RNA, 48 nt, Artificial Sequence
  Description of Artificial Sequence:  Enzymatic Nucleic Acid
ugcuggagggaggaaacucccuucaaggacaucguccgggugcuguuu

SEQ ID NO: 7465 - RNA, 48 nt, Artificial Sequence
  Description of Artificial Sequence:  Enzymatic Nucleic Acid
ucggccugggaggaaacucccuucaaggacaucguccggguggagcug

SEQ ID NO: 7466 - RNA, 48 nt, Artificial Sequence
  Description of Artificial Sequence:  Enzymatic Nucleic Acid
uccucggcggaggaaacucccuucaaggacaucguccgggugcuggag

SEQ ID NO: 7467 - RNA, 48 nt, Artificial Sequence
  Description of Artificial Sequence:  Enzymatic Nucleic Acid
cuccucggggaggaaacucccuucaaggacaucguccgggcugcugga

SEQ ID NO: 7468 - RNA, 48 nt, Artificial Sequence
  Description of Artificial Sequence:  Enzymatic Nucleic Acid
ggccuccuggaggaaacucccuucaaggacaucguccgggggccugcu

SEQ ID NO: 7469 - RNA, 48 nt, Artificial Sequence
  Description of Artificial Sequence:  Enzymatic Nucleic Acid
agggccucggaggaaacucccuucaaggacaucguccgggucggccug

SEQ ID NO: 7470 - RNA, 48 nt, Artificial Sequence
  Description of Artificial Sequence:  Enzymatic Nucleic Acid
cagggccuggaggaaacucccuucaaggacaucguccgggcucggccu

SEQ ID NO: 7471 - RNA, 48 nt, Artificial Sequence
  Description of Artificial Sequence:  Enzymatic Nucleic Acid
accagggcggaggaaacucccuucaaggacaucguccggguccucggc

SEQ ID NO: 7472 - RNA, 48 nt, Artificial Sequence
  Description of Artificial Sequence:  Enzymatic Nucleic Acid
caccagggggaggaaacucccuucaaggacaucguccgggcuccucgg

SEQ ID NO: 7473 - RNA, 48 nt, Artificial Sequence
  Description of Artificial Sequence:  Enzymatic Nucleic Acid
uuggccacggaggaaacucccuucaaggacaucguccgggagggccuc

SEQ ID NO: 7474 - RNA, 48 nt, Artificial Sequence
  Description of Artificial Sequence:  Enzymatic Nucleic Acid
uuuggccaggaggaaacucccuucaaggacaucguccgggcagggccu

SEQ ID NO: 7475 - RNA, 48 nt, Artificial Sequence
  Description of Artificial Sequence:  Enzymatic Nucleic Acid
uguuuggcggaggaaacucccuucaaggacaucguccgggaccagggc

SEQ ID NO: 7476 - RNA, 48 nt, Artificial Sequence
  Description of Artificial Sequence:  Enzymatic Nucleic Acid
cuguuuggggaggaaacucccuucaaggacaucguccgggcaccaggg

SEQ ID NO: 7477 - RNA, 48 nt, Artificial Sequence
  Description of Artificial Sequence:  Enzymatic Nucleic Acid
aucaccucggaggaaacucccuucaaggacaucguccggguguuuggc

SEQ ID NO: 7478 - RNA, 48 nt, Artificial Sequence
  Description of Artificial Sequence:  Enzymatic Nucleic Acid
gaucaccuggaggaaacucccuucaaggacaucguccgggcuguuugg

SEQ ID NO: 7479 - RNA, 48 nt, Artificial Sequence
  Description of Artificial Sequence:  Enzymatic Nucleic Acid
ucgaucacggaggaaacucccuucaaggacaucguccggguccuguuu

SEQ ID NO: 7480 - RNA, 48 nt, Artificial Sequence
  Description of Artificial Sequence:  Enzymatic Nucleic Acid
aucgaucaggaggaaacucccuucaaggacaucguccgggcuccuguu

SEQ ID NO: 7481 - RNA, 48 nt, Artificial Sequence
  Description of Artificial Sequence:  Enzymatic Nucleic Acid
uuaucgauggaggaaacucccuucaaggacaucguccgggaccuccug

SEQ ID NO: 7482 - RNA, 48 nt, Artificial Sequence
  Description of Artificial Sequence:  Enzymatic Nucleic Acid
cagcuuauggaggaaacucccuucaaggacaucguccggggaucaccu

SEQ ID NO: 7483 - RNA, 48 nt, Artificial Sequence
  Description of Artificial Sequence:  Enzymatic Nucleic Acid
uccuucagggaggaaacucccuucaaggacaucguccggguuaucgau

SEQ ID NO: 7484 - RNA, 48 nt, Artificial Sequence
  Description of Artificial Sequence:  Enzymatic Nucleic Acid
uccuccuuggaggaaacucccuucaaggacaucguccgggagcuuauc

SEQ ID NO: 7485 - RNA, 48 nt, Artificial Sequence
  Description of Artificial Sequence:  Enzymatic Nucleic Acid
gccuccucggaggaaacucccuucaaggacaucguccggguucagcuu

SEQ ID NO: 7486 - RNA, 48 nt, Artificial Sequence
  Description of Artificial Sequence:  Enzymatic Nucleic Acid
ggccuccuggaggaaacucccuucaaggacaucguccgggcuucagcu

SEQ ID NO: 7487 - RNA, 48 nt, Artificial Sequence
  Description of Artificial Sequence:  Enzymatic Nucleic Acid
ucggccucggaggaaacucccuucaaggacaucguccggguccuucag

SEQ ID NO: 7488 - RNA, 48 nt, Artificial Sequence
  Description of Artificial Sequence:  Enzymatic Nucleic Acid
cucggccuggaggaaacucccuucaaggacaucguccgggcuccuuca

SEQ ID NO: 7489 - RNA, 48 nt, Artificial Sequence
  Description of Artificial Sequence:  Enzymatic Nucleic Acid
ugcucggcggaggaaacucccuucaaggacaucguccggguccuccuu

SEQ ID NO: 7490 - RNA, 48 nt, Artificial Sequence
  Description of Artificial Sequence:  Enzymatic Nucleic Acid
cugcucggggaggaaacucccuucaaggacaucguccgggcuccuccu

SEQ ID NO: 7491 - RNA, 48 nt, Artificial Sequence
  Description of Artificial Sequence:  Enzymatic Nucleic Acid
gugcugcuggaggaaacucccuucaaggacaucguccgggggccuccu

SEQ ID NO: 7492 - RNA, 48 nt, Artificial Sequence
  Description of Artificial Sequence:  Enzymatic Nucleic Acid
uugugcugggaggaaacucccuucaaggacaucguccgggucggccuc

SEQ ID NO: 7493 - RNA, 48 nt, Artificial Sequence
  Description of Artificial Sequence:  Enzymatic Nucleic Acid
aucuugugggaggaaacucccuucaaggacaucguccgggugcucggc

SEQ ID NO: 7494 - RNA, 48 nt, Artificial Sequence
  Description of Artificial Sequence:  Enzymatic Nucleic Acid
aucacaauggaggaaacucccuucaaggacaucguccggguugugcug

SEQ ID NO: 7495 - RNA, 48 nt, Artificial Sequence
  Description of Artificial Sequence:  Enzymatic Nucleic Acid
cuccaucaggaggaaacucccuucaaggacaucguccgggaaucuugu

SEQ ID NO: 7496 - RNA, 48 nt, Artificial Sequence
  Description of Artificial Sequence:  Enzymatic Nucleic Acid
gucuccauggaggaaacucccuucaaggacaucguccgggacaaucuu

SEQ ID NO: 7497 - RNA, 48 nt, Artificial Sequence
  Description of Artificial Sequence:  Enzymatic Nucleic Acid
acggucucggaggaaacucccuucaaggacaucguccgggaucacaau

SEQ ID NO: 7498 - RNA, 48 nt, Artificial Sequence
  Description of Artificial Sequence:  Enzymatic Nucleic Acid
aacggucuggaggaaacucccuucaaggacaucguccgggcaucacaa

SEQ ID NO: 7499 - RNA, 48 nt, Artificial Sequence
  Description of Artificial Sequence:  Enzymatic Nucleic Acid
ggaacgguggaggaaacucccuucaaggacaucguccggguccaucac

SEQ ID NO: 7500 - RNA, 48 nt, Artificial Sequence
  Description of Artificial Sequence:  Enzymatic Nucleic Acid
caccggaaggaggaaacucccuucaaggacaucguccgggggucucca

SEQ ID NO: 7501 - RNA, 48 nt, Artificial Sequence
  Description of Artificial Sequence:  Enzymatic Nucleic Acid
uucagcacggaggaaacucccuucaaggacaucguccgggggaacggu

SEQ ID NO: 7502 - RNA, 48 nt, Artificial Sequence
  Description of Artificial Sequence:  Enzymatic Nucleic Acid
cuucagcaggaggaaacucccuucaaggacaucguccgggcggaacgg

SEQ ID NO: 7503 - RNA, 48 nt, Artificial Sequence
  Description of Artificial Sequence:  Enzymatic Nucleic Acid
gccuucagggaggaaacucccuucaaggacaucguccgggaccggaac

SEQ ID NO: 7504 - RNA, 48 nt, Artificial Sequence
  Description of Artificial Sequence:  Enzymatic Nucleic Acid
ugggccuuggaggaaacucccuucaaggacaucguccgggagcaccgg

SEQ ID NO: 7505 - RNA, 48 nt, Artificial Sequence
  Description of Artificial Sequence:  Enzymatic Nucleic Acid
gccugggcggaggaaacucccuucaaggacaucguccggguucagcac

SEQ ID NO: 7506 - RNA, 48 nt, Artificial Sequence
  Description of Artificial Sequence:  Enzymatic Nucleic Acid
cgccugggggaggaaacucccuucaaggacaucguccgggcuucagca

SEQ ID NO: 7507 - RNA, 48 nt, Artificial Sequence
  Description of Artificial Sequence:  Enzymatic Nucleic Acid
auauccgcggaggaaacucccuucaaggacaucguccgggugggccuu

SEQ ID NO: 7508 - RNA, 48 nt, Artificial Sequence
  Description of Artificial Sequence:  Enzymatic Nucleic Acid
gauauccgggaggaaacucccuucaaggacaucguccgggcugggccu

SEQ ID NO: 7509 - RNA, 48 nt, Artificial Sequence
  Description of Artificial Sequence:  Enzymatic Nucleic Acid
uagauaucggaggaaacucccuucaaggacaucguccggggccugggc

SEQ ID NO: 7510 - RNA, 48 nt, Artificial Sequence
  Description of Artificial Sequence:  Enzymatic Nucleic Acid
guagauauggaggaaacucccuucaaggacaucguccgggcgccuggg

SEQ ID NO: 7511 - RNA, 48 nt, Artificial Sequence
  Description of Artificial Sequence:  Enzymatic Nucleic Acid
aaguccgcggaggaaacucccuucaaggacaucguccggguuguagau

SEQ ID NO: 7512 - RNA, 48 nt, Artificial Sequence
  Description of Artificial Sequence:  Enzymatic Nucleic Acid
gaaguccgggaggaaacucccuucaaggacaucguccgggcuuguaga

SEQ ID NO: 7513 - RNA, 48 nt, Artificial Sequence
  Description of Artificial Sequence:  Enzymatic Nucleic Acid
uggaagucggaggaaacucccuucaaggacaucguccggggccuugua

SEQ ID NO: 7514 - RNA, 48 nt, Artificial Sequence
  Description of Artificial Sequence:  Enzymatic Nucleic Acid
cuggaaguggaggaaacucccuucaaggacaucguccgggcgccuugu

SEQ ID NO: 7515 - RNA, 48 nt, Artificial Sequence
  Description of Artificial Sequence:  Enzymatic Nucleic Acid
cucucagcggaggaaacucccuucaaggacaucguccggguggaaguc

SEQ ID NO: 7516 - RNA, 48 nt, Artificial Sequence
  Description of Artificial Sequence:  Enzymatic Nucleic Acid
ccucucagggaggaaacucccuucaaggacaucguccgggcuggaagu

SEQ ID NO: 7517 - RNA, 48 nt, Artificial Sequence
  Description of Artificial Sequence:  Enzymatic Nucleic Acid
cugccucuggaggaaacucccuucaaggacaucguccgggagccugga

SEQ ID NO: 7518 - RNA, 48 nt, Artificial Sequence
  Description of Artificial Sequence:  Enzymatic Nucleic Acid
gccugccuggaggaaacucccuucaaggacaucguccgggucagccug

SEQ ID NO: 7519 - RNA, 48 nt, Artificial Sequence
  Description of Artificial Sequence:  Enzymatic Nucleic Acid
gggccugcggaggaaacucccuucaaggacaucguccgggucucagcc

SEQ ID NO: 7520 - RNA, 48 nt, Artificial Sequence
  Description of Artificial Sequence:  Enzymatic Nucleic Acid
cgggccugggaggaaacucccuucaaggacaucguccgggcucucagc

SEQ ID NO: 7521 - RNA, 48 nt, Artificial Sequence
  Description of Artificial Sequence:  Enzymatic Nucleic Acid
ucccgggcggaggaaacucccuucaaggacaucguccgggugccucuc

SEQ ID NO: 7522 - RNA, 48 nt, Artificial Sequence
  Description of Artificial Sequence:  Enzymatic Nucleic Acid
cucccgggggaggaaacucccuucaaggacaucguccgggcugccucu

SEQ ID NO: 7523 - RNA, 48 nt, Artificial Sequence
  Description of Artificial Sequence:  Enzymatic Nucleic Acid
gcuucuccggaggaaacucccuucaaggacaucguccggggggccugc

SEQ ID NO: 7524 - RNA, 48 nt, Artificial Sequence
  Description of Artificial Sequence:  Enzymatic Nucleic Acid
agcuucucggaggaaacucccuucaaggacaucguccgggcgggccug

SEQ ID NO: 7525 - RNA, 48 nt, Artificial Sequence
  Description of Artificial Sequence:  Enzymatic Nucleic Acid
cagcuucuggaggaaacucccuucaaggacaucguccgggccgggccu

SEQ ID NO: 7526 - RNA, 48 nt, Artificial Sequence
  Description of Artificial Sequence:  Enzymatic Nucleic Acid
gccagcuuggaggaaacucccuucaaggacaucguccgggucccgggc

SEQ ID NO: 7527 - RNA, 48 nt, Artificial Sequence
  Description of Artificial Sequence:  Enzymatic Nucleic Acid
ucggccagggaggaaacucccuucaaggacaucguccggguucucccg

SEQ ID NO: 7528 - RNA, 48 nt, Artificial Sequence
  Description of Artificial Sequence:  Enzymatic Nucleic Acid
uucucggcggaggaaacucccuucaaggacaucguccgggagcuucuc

SEQ ID NO: 7529 - RNA, 48 nt, Artificial Sequence
  Description of Artificial Sequence:  Enzymatic Nucleic Acid
cuucucggggaggaaacucccuucaaggacaucguccgggcagcuucu

SEQ ID NO: 7530 - RNA, 48 nt, Artificial Sequence
  Description of Artificial Sequence:  Enzymatic Nucleic Acid
cuucuucuggaggaaacucccuucaaggacaucguccgggggccagcu

SEQ ID NO: 7531 - RNA, 48 nt, Artificial Sequence
  Description of Artificial Sequence:  Enzymatic Nucleic Acid
uccuucuuggaggaaacucccuucaaggacaucguccgggucggccag

SEQ ID NO: 7532 - RNA, 48 nt, Artificial Sequence
  Description of Artificial Sequence:  Enzymatic Nucleic Acid
agcuccuuggaggaaacucccuucaaggacaucguccggguucucggc

SEQ ID NO: 7533 - RNA, 48 nt, Artificial Sequence
  Description of Artificial Sequence:  Enzymatic Nucleic Acid
aggagcucggaggaaacucccuucaaggacaucguccggguucuucuc

SEQ ID NO: 7534 - RNA, 48 nt, Artificial Sequence
  Description of Artificial Sequence:  Enzymatic Nucleic Acid
caggagcuggaggaaacucccuucaaggacaucguccgggcuucuucu

SEQ ID NO: 7535 - RNA, 48 nt, Artificial Sequence
  Description of Artificial Sequence:  Enzymatic Nucleic Acid
ugcaggagggaggaaacucccuucaaggacaucguccggguccuucuu

SEQ ID NO: 7536 - RNA, 48 nt, Artificial Sequence
  Description of Artificial Sequence:  Enzymatic Nucleic Acid
ugcuccugggaggaaacucccuucaaggacaucguccgggaggagcuc

SEQ ID NO: 7537 - RNA, 48 nt, Artificial Sequence
  Description of Artificial Sequence:  Enzymatic Nucleic Acid
agcugcucggaggaaacucccuucaaggacaucguccgggugcaggag

SEQ ID NO: 7538 - RNA, 48 nt, Artificial Sequence
  Description of Artificial Sequence:  Enzymatic Nucleic Acid
cagcugcuggaggaaacucccuucaaggacaucguccgggcugcagga

SEQ ID NO: 7539 - RNA, 48 nt, Artificial Sequence
  Description of Artificial Sequence:  Enzymatic Nucleic Acid
uccagcugggaggaaacucccuucaaggacaucguccggguccugcag

SEQ ID NO: 7540 - RNA, 48 nt, Artificial Sequence
  Description of Artificial Sequence:  Enzymatic Nucleic Acid
ugcuccagggaggaaacucccuucaaggacaucguccgggugcuccug

SEQ ID NO: 7541 - RNA, 48 nt, Artificial Sequence
  Description of Artificial Sequence:  Enzymatic Nucleic Acid
agcugcucggaggaaacucccuucaaggacaucguccgggagcugcuc

SEQ ID NO: 7542 - RNA, 48 nt, Artificial Sequence
  Description of Artificial Sequence:  Enzymatic Nucleic Acid
cagcugcuggaggaaacucccuucaaggacaucguccgggcagcugcu

SEQ ID NO: 7543 - RNA, 48 nt, Artificial Sequence
  Description of Artificial Sequence:  Enzymatic Nucleic Acid
ugcagcugggaggaaacucccuucaaggacaucguccggguccagcug

SEQ ID NO: 7544 - RNA, 48 nt, Artificial Sequence
  Description of Artificial Sequence:  Enzymatic Nucleic Acid
cucugcagggaggaaacucccuucaaggacaucguccgggugcuccag

SEQ ID NO: 7545 - RNA, 48 nt, Artificial Sequence
  Description of Artificial Sequence:  Enzymatic Nucleic Acid
ucccucugggaggaaacucccuucaaggacaucguccgggagcugcuc

SEQ ID NO: 7546 - RNA, 48 nt, Artificial Sequence
  Description of Artificial Sequence:  Enzymatic Nucleic Acid
uacucccuggaggaaacucccuucaaggacaucguccgggugcagcug

SEQ ID NO: 7547 - RNA, 48 nt, Artificial Sequence
  Description of Artificial Sequence:  Enzymatic Nucleic Acid
uguacuccggaggaaacucccuucaaggacaucguccgggucugcagc

SEQ ID NO: 7548 - RNA, 48 nt, Artificial Sequence
  Description of Artificial Sequence:  Enzymatic Nucleic Acid
cuguacucggaggaaacucccuucaaggacaucguccgggcucugcag

SEQ ID NO: 7549 - RNA, 48 nt, Artificial Sequence
  Description of Artificial Sequence:  Enzymatic Nucleic Acid
gcuguacuggaggaaacucccuucaaggacaucguccgggccucugca

SEQ ID NO: 7550 - RNA, 48 nt, Artificial Sequence
  Description of Artificial Sequence:  Enzymatic Nucleic Acid
uugcuguaggaggaaacucccuucaaggacaucguccgggucccucug

SEQ ID NO: 7551 - RNA, 48 nt, Artificial Sequence
  Description of Artificial Sequence:  Enzymatic Nucleic Acid
ucaguuugggaggaaacucccuucaaggacaucguccggguguacucc

SEQ ID NO: 7552 - RNA, 48 nt, Artificial Sequence
  Description of Artificial Sequence:  Enzymatic Nucleic Acid
cuggccuuggaggaaacucccuucaaggacaucguccgggaguuugcu

SEQ ID NO: 7553 - RNA, 48 nt, Artificial Sequence
  Description of Artificial Sequence:  Enzymatic Nucleic Acid
cagcuggcggaggaaacucccuucaaggacaucguccggguucaguuu

SEQ ID NO: 7554 - RNA, 48 nt, Artificial Sequence
  Description of Artificial Sequence:  Enzymatic Nucleic Acid
acagcuggggaggaaacucccuucaaggacaucguccgggcuucaguu

SEQ ID NO: 7555 - RNA, 48 nt, Artificial Sequence
  Description of Artificial Sequence:  Enzymatic Nucleic Acid
ccugacagggaggaaacucccuucaaggacaucguccggguggccuuc

SEQ ID NO: 7556 - RNA, 48 nt, Artificial Sequence
  Description of Artificial Sequence:  Enzymatic Nucleic Acid
acuccugaggaggaaacucccuucaaggacaucguccgggagcuggcc

SEQ ID NO: 7557 - RNA, 48 nt, Artificial Sequence
  Description of Artificial Sequence:  Enzymatic Nucleic Acid
gccgacucggaggaaacucccuucaaggacaucguccgggugacagcu

SEQ ID NO: 7558 - RNA, 48 nt, Artificial Sequence
  Description of Artificial Sequence:  Enzymatic Nucleic Acid
ggccgacuggaggaaacucccuucaaggacaucguccgggcugacagc

SEQ ID NO: 7559 - RNA, 48 nt, Artificial Sequence
  Description of Artificial Sequence:  Enzymatic Nucleic Acid
cuggccgaggaggaaacucccuucaaggacaucguccggguccugaca

SEQ ID NO: 7560 - RNA, 48 nt, Artificial Sequence
  Description of Artificial Sequence:  Enzymatic Nucleic Acid
auccuggcggaggaaacucccuucaaggacaucguccggggacuccug

SEQ ID NO: 7561 - RNA, 48 nt, Artificial Sequence
  Description of Artificial Sequence:  Enzymatic Nucleic Acid
gauccuggggaggaaacucccuucaaggacaucguccgggcgacuccu

SEQ ID NO: 7562 - RNA, 48 nt, Artificial Sequence
  Description of Artificial Sequence:  Enzymatic Nucleic Acid
ccucgaucggaggaaacucccuucaaggacaucguccggguggccgac

SEQ ID NO: 7563 - RNA, 48 nt, Artificial Sequence
  Description of Artificial Sequence:  Enzymatic Nucleic Acid
uccucgauggaggaaacucccuucaaggacaucguccgggcuggccga

SEQ ID NO: 7564 - RNA, 48 nt, Artificial Sequence
  Description of Artificial Sequence:  Enzymatic Nucleic Acid
cauguccuggaggaaacucccuucaaggacaucguccggggauccugg

SEQ ID NO: 7565 - RNA, 48 nt, Artificial Sequence
  Description of Artificial Sequence:  Enzymatic Nucleic Acid
cucaugucggaggaaacucccuucaaggacaucguccgggucgauccu

SEQ ID NO: 7566 - RNA, 48 nt, Artificial Sequence
  Description of Artificial Sequence:  Enzymatic Nucleic Acid
ccucauguggaggaaacucccuucaaggacaucguccgggcucgaucc

SEQ ID NO: 7567 - RNA, 48 nt, Artificial Sequence
  Description of Artificial Sequence:  Enzymatic Nucleic Acid
cgcuuccuggaggaaacucccuucaaggacaucguccgggauguccuc

SEQ ID NO: 7568 - RNA, 48 nt, Artificial Sequence
  Description of Artificial Sequence:  Enzymatic Nucleic Acid
gccgcuucggaggaaacucccuucaaggacaucguccgggucaugucc

SEQ ID NO: 7569 - RNA, 48 nt, Artificial Sequence
  Description of Artificial Sequence:  Enzymatic Nucleic Acid
ugccgcuuggaggaaacucccuucaaggacaucguccgggcucauguc

SEQ ID NO: 7570 - RNA, 48 nt, Artificial Sequence
  Description of Artificial Sequence:  Enzymatic Nucleic Acid
acaugccgggaggaaacucccuucaaggacaucguccggguuccucau

SEQ ID NO: 7571 - RNA, 48 nt, Artificial Sequence
  Description of Artificial Sequence:  Enzymatic Nucleic Acid
cgacaugcggaggaaacucccuucaaggacaucguccggggcuuccuc

SEQ ID NO: 7572 - RNA, 48 nt, Artificial Sequence
  Description of Artificial Sequence:  Enzymatic Nucleic Acid
ucgacaugggaggaaacucccuucaaggacaucguccgggcgcuuccu

SEQ ID NO: 7573 - RNA, 48 nt, Artificial Sequence
  Description of Artificial Sequence:  Enzymatic Nucleic Acid
gaccucgaggaggaaacucccuucaaggacaucguccgggaugccgcu

SEQ ID NO: 7574 - RNA, 48 nt, Artificial Sequence
  Description of Artificial Sequence:  Enzymatic Nucleic Acid
ggagaccuggaggaaacucccuucaaggacaucguccggggacaugcc

SEQ ID NO: 7575 - RNA, 48 nt, Artificial Sequence
  Description of Artificial Sequence:  Enzymatic Nucleic Acid
ugggagacggaggaaacucccuucaaggacaucguccgggucgacaug

SEQ ID NO: 7576 - RNA, 48 nt, Artificial Sequence
  Description of Artificial Sequence:  Enzymatic Nucleic Acid
cugggagaggaggaaacucccuucaaggacaucguccgggcucgacau

SEQ ID NO: 7577 - RNA, 48 nt, Artificial Sequence
  Description of Artificial Sequence:  Enzymatic Nucleic Acid
aagggggcggaggaaacucccuucaaggacaucguccgggugggagac

SEQ ID NO: 7578 - RNA, 48 nt, Artificial Sequence
  Description of Artificial Sequence:  Enzymatic Nucleic Acid
caagggggggaggaaacucccuucaaggacaucguccgggcugggaga

SEQ ID NO: 7579 - RNA, 48 nt, Artificial Sequence
  Description of Artificial Sequence:  Enzymatic Nucleic Acid
gcggggggggaggaaacucccuucaaggacaucguccgggaagggggc

SEQ ID NO: 7580 - RNA, 48 nt, Artificial Sequence
  Description of Artificial Sequence:  Enzymatic Nucleic Acid
ggcaggggggaggaaacucccuucaaggacaucguccgggggggggca

SEQ ID NO: 7581 - RNA, 48 nt, Artificial Sequence
  Description of Artificial Sequence:  Enzymatic Nucleic Acid
gagguaggggaggaaacucccuucaaggacaucguccgggaggggcgg

SEQ ID NO: 7582 - RNA, 48 nt, Artificial Sequence
  Description of Artificial Sequence:  Enzymatic Nucleic Acid
ggcagggcggaggaaacucccuucaaggacaucguccgggaggggaga

SEQ ID NO: 7583 - RNA, 48 nt, Artificial Sequence
  Description of Artificial Sequence:  Enzymatic Nucleic Acid
gggcagggggaggaaacucccuucaaggacaucguccgggcaggggag

SEQ ID NO: 7584 - RNA, 48 nt, Artificial Sequence
  Description of Artificial Sequence:  Enzymatic Nucleic Acid
uggcugggggaggaaacucccuucaaggacaucguccgggagggccag

SEQ ID NO: 7585 - RNA, 48 nt, Artificial Sequence
  Description of Artificial Sequence:  Enzymatic Nucleic Acid
uccucuggggaggaaacucccuucaaggacaucguccgggugggcagg

SEQ ID NO: 7586 - RNA, 48 nt, Artificial Sequence
  Description of Artificial Sequence:  Enzymatic Nucleic Acid
cuccuccuggaggaaacucccuucaaggacaucguccggguggcuggg

SEQ ID NO: 7587 - RNA, 48 nt, Artificial Sequence
  Description of Artificial Sequence:  Enzymatic Nucleic Acid
ggcuccucggaggaaacucccuucaaggacaucguccgggucuggcug

SEQ ID NO: 7588 - RNA, 48 nt, Artificial Sequence
  Description of Artificial Sequence:  Enzymatic Nucleic Acid
gggcuccuggaggaaacucccuucaaggacaucguccgggcucuggcu

SEQ ID NO: 7589 - RNA, 48 nt, Artificial Sequence
  Description of Artificial Sequence:  Enzymatic Nucleic Acid
gggggcucggaggaaacucccuucaaggacaucguccggguccucugg

SEQ ID NO: 7590 - RNA, 48 nt, Artificial Sequence
  Description of Artificial Sequence:  Enzymatic Nucleic Acid
ggggggcuggaggaaacucccuucaaggacaucguccgggcuccucug

SEQ ID NO: 7591 - RNA, 48 nt, Artificial Sequence
  Description of Artificial Sequence:  Enzymatic Nucleic Acid
cgggggggggaggaaacucccuucaaggacaucguccggguccuccuc

SEQ ID NO: 7592 - RNA, 48 nt, Artificial Sequence
  Description of Artificial Sequence:  Enzymatic Nucleic Acid
uggcuccuggaggaaacucccuucaaggacaucguccggggggggggc

SEQ ID NO: 7593 - RNA, 48 nt, Artificial Sequence
  Description of Artificial Sequence:  Enzymatic Nucleic Acid
gguggcucggaggaaacucccuucaaggacaucguccgggucgggggg

SEQ ID NO: 7594 - RNA, 48 nt, Artificial Sequence
  Description of Artificial Sequence:  Enzymatic Nucleic Acid
agguggcuggaggaaacucccuucaaggacaucguccgggcucggggg

SEQ ID NO: 7595 - RNA, 48 nt, Artificial Sequence
  Description of Artificial Sequence:  Enzymatic Nucleic Acid
ucagguggggaggaaacucccuucaaggacaucguccggguccucggg

SEQ ID NO: 7596 - RNA, 48 nt, Artificial Sequence
  Description of Artificial Sequence:  Enzymatic Nucleic Acid
gcagaaguggaggaaacucccuucaaggacaucguccgggagguggcu

SEQ ID NO: 7597 - RNA, 48 nt, Artificial Sequence
  Description of Artificial Sequence:  Enzymatic Nucleic Acid
ugggacagggaggaaacucccuucaaggacaucguccgggagaaguca

SEQ ID NO: 7598 - RNA, 48 nt, Artificial Sequence
  Description of Artificial Sequence:  Enzymatic Nucleic Acid
acuugggaggaggaaacucccuucaaggacaucguccgggagcagaag

SEQ ID NO: 7599 - RNA, 48 nt, Artificial Sequence
  Description of Artificial Sequence:  Enzymatic Nucleic Acid
uacuggcaggaggaaacucccuucaaggacaucguccggguugggaca

SEQ ID NO: 7600 - RNA, 48 nt, Artificial Sequence
  Description of Artificial Sequence:  Enzymatic Nucleic Acid
gauacuggggaggaaacucccuucaaggacaucguccgggacuuggga

SEQ ID NO: 7601 - RNA, 48 nt, Artificial Sequence
  Description of Artificial Sequence:  Enzymatic Nucleic Acid
gccugauaggaggaaacucccuucaaggacaucguccggguggcacuu

SEQ ID NO: 7602 - RNA, 48 nt, Artificial Sequence
  Description of Artificial Sequence:  Enzymatic Nucleic Acid
ucaggggcggaggaaacucccuucaaggacaucguccgggugauacug

SEQ ID NO: 7603 - RNA, 48 nt, Artificial Sequence
  Description of Artificial Sequence:  Enzymatic Nucleic Acid
aucaggggggaggaaacucccuucaaggacaucguccgggcugauacu

SEQ ID NO: 7604 - RNA, 48 nt, Artificial Sequence
  Description of Artificial Sequence:  Enzymatic Nucleic Acid
guccauauggaggaaacucccuucaaggacaucguccgggaggggccu

SEQ ID NO: 7605 - RNA, 48 nt, Artificial Sequence
  Description of Artificial Sequence:  Enzymatic Nucleic Acid
agggugucggaggaaacucccuucaaggacaucguccgggauaucagg

SEQ ID NO: 7606 - RNA, 48 nt, Artificial Sequence
  Description of Artificial Sequence:  Enzymatic Nucleic Acid
caggguguggaggaaacucccuucaaggacaucguccgggcauaucag

SEQ ID NO: 7607 - RNA, 48 nt, Artificial Sequence
  Description of Artificial Sequence:  Enzymatic Nucleic Acid
uguaucugggaggaaacucccuucaaggacaucguccgggaggguguc

SEQ ID NO: 7608 - RNA, 48 nt, Artificial Sequence
  Description of Artificial Sequence:  Enzymatic Nucleic Acid
acauguauggaggaaacucccuucaaggacaucguccgggugcagggu

SEQ ID NO: 7609 - RNA, 48 nt, Artificial Sequence
  Description of Artificial Sequence:  Enzymatic Nucleic Acid
cuccaugaggaggaaacucccuucaaggacaucguccgggauguaucu

SEQ ID NO: 7610 - RNA, 48 nt, Artificial Sequence
  Description of Artificial Sequence:  Enzymatic Nucleic Acid
augcacucggaggaaacucccuucaaggacaucguccgggaugacaug

SEQ ID NO: 7611 - RNA, 48 nt, Artificial Sequence
  Description of Artificial Sequence:  Enzymatic Nucleic Acid
aaugcacuggaggaaacucccuucaaggacaucguccgggcaugacau

SEQ ID NO: 7612 - RNA, 48 nt, Artificial Sequence
  Description of Artificial Sequence:  Enzymatic Nucleic Acid
ucaaugcaggaggaaacucccuucaaggacaucguccggguccaugac

SEQ ID NO: 7613 - RNA, 48 nt, Artificial Sequence
  Description of Artificial Sequence:  Enzymatic Nucleic Acid
acucaaugggaggaaacucccuucaaggacaucguccgggacuccaug

SEQ ID NO: 7614 - RNA, 48 nt, Artificial Sequence
  Description of Artificial Sequence:  Enzymatic Nucleic Acid
gcccuacuggaggaaacucccuucaaggacaucguccgggaaugcacu

SEQ ID NO: 7615 - RNA, 48 nt, Artificial Sequence
  Description of Artificial Sequence:  Enzymatic Nucleic Acid
cggcccuaggaggaaacucccuucaaggacaucguccgggucaaugca

SEQ ID NO: 7616 - RNA, 48 nt, Artificial Sequence
  Description of Artificial Sequence:  Enzymatic Nucleic Acid
ggccggccggaggaaacucccuucaaggacaucguccggguacucaau

SEQ ID NO: 7617 - RNA, 48 nt, Artificial Sequence
  Description of Artificial Sequence:  Enzymatic Nucleic Acid
uggccggcggaggaaacucccuucaaggacaucguccgggcuacucaa

SEQ ID NO: 7618 - RNA, 48 nt, Artificial Sequence
  Description of Artificial Sequence:  Enzymatic Nucleic Acid
cuggccggggaggaaacucccuucaaggacaucguccgggccuacuca

SEQ ID NO: 7619 - RNA, 48 nt, Artificial Sequence
  Description of Artificial Sequence:  Enzymatic Nucleic Acid
gcacuggcggaggaaacucccuucaaggacaucguccgggggcccuac

SEQ ID NO: 7620 - RNA, 48 nt, Artificial Sequence
  Description of Artificial Sequence:  Enzymatic Nucleic Acid
ugcacuggggaggaaacucccuucaaggacaucguccgggcggcccua

SEQ ID NO: 7621 - RNA, 48 nt, Artificial Sequence
  Description of Artificial Sequence:  Enzymatic Nucleic Acid
gccuugcaggaggaaacucccuucaaggacaucguccggguggccggc

SEQ ID NO: 7622 - RNA, 48 nt, Artificial Sequence
  Description of Artificial Sequence:  Enzymatic Nucleic Acid
uggccuugggaggaaacucccuucaaggacaucguccgggacuggccg

SEQ ID NO: 7623 - RNA, 48 nt, Artificial Sequence
  Description of Artificial Sequence:  Enzymatic Nucleic Acid
gcaguggcggaggaaacucccuucaaggacaucguccggguugcacug

SEQ ID NO: 7624 - RNA, 48 nt, Artificial Sequence
  Description of Artificial Sequence:  Enzymatic Nucleic Acid
ggcaguggggaggaaacucccuucaaggacaucguccgggcuugcacu

SEQ ID NO: 7625 - RNA, 48 nt, Artificial Sequence
  Description of Artificial Sequence:  Enzymatic Nucleic Acid
cgggcaggggaggaaacucccuucaaggacaucguccgggaguggccu

SEQ ID NO: 7626 - RNA, 48 nt, Artificial Sequence
  Description of Artificial Sequence:  Enzymatic Nucleic Acid
uccucgggggaggaaacucccuucaaggacaucguccgggaggcagug

SEQ ID NO: 7627 - RNA, 48 nt, Artificial Sequence
  Description of Artificial Sequence:  Enzymatic Nucleic Acid
cacguccuggaggaaacucccuucaaggacaucguccggggggcaggc

SEQ ID NO: 7628 - RNA, 48 nt, Artificial Sequence
  Description of Artificial Sequence:  Enzymatic Nucleic Acid
ggcacgucggaggaaacucccuucaaggacaucguccgggucgggcag

SEQ ID NO: 7629 - RNA, 48 nt, Artificial Sequence
  Description of Artificial Sequence:  Enzymatic Nucleic Acid
gggcacguggaggaaacucccuucaaggacaucguccgggcucgggca

SEQ ID NO: 7630 - RNA, 48 nt, Artificial Sequence
  Description of Artificial Sequence:  Enzymatic Nucleic Acid
cccgggcaggaggaaacucccuucaaggacaucguccgggguccucgg

SEQ ID NO: 7631 - RNA, 48 nt, Artificial Sequence
  Description of Artificial Sequence:  Enzymatic Nucleic Acid
gucccgggggaggaaacucccuucaaggacaucguccgggacguccuc

SEQ ID NO: 7632 - RNA, 48 nt, Artificial Sequence
  Description of Artificial Sequence:  Enzymatic Nucleic Acid
cacgguccggaggaaacucccuucaaggacaucguccggggggcacgu

SEQ ID NO: 7633 - RNA, 48 nt, Artificial Sequence
  Description of Artificial Sequence:  Enzymatic Nucleic Acid
gcacggucggaggaaacucccuucaaggacaucguccgggcgggcacg

SEQ ID NO: 7634 - RNA, 48 nt, Artificial Sequence
  Description of Artificial Sequence:  Enzymatic Nucleic Acid
ugcacgguggaggaaacucccuucaaggacaucguccgggccgggcac

SEQ ID NO: 7635 - RNA, 48 nt, Artificial Sequence
  Description of Artificial Sequence:  Enzymatic Nucleic Acid
agacugcaggaggaaacucccuucaaggacaucguccgggggucccgg

SEQ ID NO: 7636 - RNA, 48 nt, Artificial Sequence
  Description of Artificial Sequence:  Enzymatic Nucleic Acid
gcagacugggaggaaacucccuucaaggacaucguccgggacgguccc

SEQ ID NO: 7637 - RNA, 48 nt, Artificial Sequence
  Description of Artificial Sequence:  Enzymatic Nucleic Acid
agcgcagaggaggaaacucccuucaaggacaucguccgggugcacggu

SEQ ID NO: 7638 - RNA, 48 nt, Artificial Sequence
  Description of Artificial Sequence:  Enzymatic Nucleic Acid
ggaaagcgggaggaaacucccuucaaggacaucguccgggagacugca

SEQ ID NO: 7639 - RNA, 48 nt, Artificial Sequence
  Description of Artificial Sequence:  Enzymatic Nucleic Acid
gaggaaagggaggaaacucccuucaaggacaucguccggggcagacug

SEQ ID NO: 7640 - RNA, 48 nt, Artificial Sequence
  Description of Artificial Sequence:  Enzymatic Nucleic Acid
uaggcaggggaggaaacucccuucaaggacaucguccggggggagagg

SEQ ID NO: 7641 - RNA, 48 nt, Artificial Sequence
  Description of Artificial Sequence:  Enzymatic Nucleic Acid
gggcuaggggaggaaacucccuucaaggacaucguccgggaggcggga

SEQ ID NO: 7642 - RNA, 48 nt, Artificial Sequence
  Description of Artificial Sequence:  Enzymatic Nucleic Acid
auccugggggaggaaacucccuucaaggacaucguccggguaggcagg

SEQ ID NO: 7643 - RNA, 48 nt, Artificial Sequence
  Description of Artificial Sequence:  Enzymatic Nucleic Acid
ccuucaucggaggaaacucccuucaaggacaucguccgggugggcuag

SEQ ID NO: 7644 - RNA, 48 nt, Artificial Sequence
  Description of Artificial Sequence:  Enzymatic Nucleic Acid
cccuucauggaggaaacucccuucaaggacaucguccgggcugggcua

SEQ ID NO: 7645 - RNA, 48 nt, Artificial Sequence
  Description of Artificial Sequence:  Enzymatic Nucleic Acid
cagcccuuggaggaaacucccuucaaggacaucguccgggauccuggg

SEQ ID NO: 7646 - RNA, 48 nt, Artificial Sequence
  Description of Artificial Sequence:  Enzymatic Nucleic Acid
acccagccggaggaaacucccuucaaggacaucguccggguucauccu

SEQ ID NO: 7647 - RNA, 48 nt, Artificial Sequence
  Description of Artificial Sequence:  Enzymatic Nucleic Acid
cacccagcggaggaaacucccuucaaggacaucguccgggcuucaucc

SEQ ID NO: 7648 - RNA, 48 nt, Artificial Sequence
  Description of Artificial Sequence:  Enzymatic Nucleic Acid
ccacccagggaggaaacucccuucaaggacaucguccgggccuucauc

SEQ ID NO: 7649 - RNA, 48 nt, Artificial Sequence
  Description of Artificial Sequence:  Enzymatic Nucleic Acid
uggccaccggaggaaacucccuucaaggacaucguccgggagcccuuc

SEQ ID NO: 7650 - RNA, 48 nt, Artificial Sequence
  Description of Artificial Sequence:  Enzymatic Nucleic Acid
guggccacggaggaaacucccuucaaggacaucguccgggcagcccuu

SEQ ID NO: 7651 - RNA, 48 nt, Artificial Sequence
  Description of Artificial Sequence:  Enzymatic Nucleic Acid
uguggccaggaggaaacucccuucaaggacaucguccgggccagcccu

SEQ ID NO: 7652 - RNA, 48 nt, Artificial Sequence
  Description of Artificial Sequence:  Enzymatic Nucleic Acid
guuguggcggaggaaacucccuucaaggacaucguccgggacccagcc

SEQ ID NO: 7653 - RNA, 48 nt, Artificial Sequence
  Description of Artificial Sequence:  Enzymatic Nucleic Acid
aguuguggggaggaaacucccuucaaggacaucguccgggcacccagc

SEQ ID NO: 7654 - RNA, 48 nt, Artificial Sequence
  Description of Artificial Sequence:  Enzymatic Nucleic Acid
uggcauccggaggaaacucccuucaaggacaucguccgggaguugugg

SEQ ID NO: 7655 - RNA, 48 nt, Artificial Sequence
  Description of Artificial Sequence:  Enzymatic Nucleic Acid
guggcaucggaggaaacucccuucaaggacaucguccgggcaguugug

SEQ ID NO: 7656 - RNA, 48 nt, Artificial Sequence
  Description of Artificial Sequence:  Enzymatic Nucleic Acid
gguggcauggaggaaacucccuucaaggacaucguccgggccaguugu

SEQ ID NO: 7657 - RNA, 48 nt, Artificial Sequence
  Description of Artificial Sequence:  Enzymatic Nucleic Acid
ccagguggggaggaaacucccuucaaggacaucguccgggaucccagu

SEQ ID NO: 7658 - RNA, 48 nt, Artificial Sequence
  Description of Artificial Sequence:  Enzymatic Nucleic Acid
uggggcucggaggaaacucccuucaaggacaucguccgggagguggca

SEQ ID NO: 7659 - RNA, 48 nt, Artificial Sequence
  Description of Artificial Sequence:  Enzymatic Nucleic Acid
guggggcuggaggaaacucccuucaaggacaucguccgggcagguggc

SEQ ID NO: 7660 - RNA, 48 nt, Artificial Sequence
  Description of Artificial Sequence:  Enzymatic Nucleic Acid
ggguggggggaggaaacucccuucaaggacaucguccggguccaggug

SEQ ID NO: 7661 - RNA, 48 nt, Artificial Sequence
  Description of Artificial Sequence:  Enzymatic Nucleic Acid
gccagcucggaggaaacucccuucaaggacaucguccggguggguggg

SEQ ID NO: 7662 - RNA, 48 nt, Artificial Sequence
  Description of Artificial Sequence:  Enzymatic Nucleic Acid
ggccagcuggaggaaacucccuucaaggacaucguccgggcugggugg

SEQ ID NO: 7663 - RNA, 48 nt, Artificial Sequence
  Description of Artificial Sequence:  Enzymatic Nucleic Acid
gcggccagggaggaaacucccuucaaggacaucguccggguccugggu

SEQ ID NO: 7664 - RNA, 48 nt, Artificial Sequence
  Description of Artificial Sequence:  Enzymatic Nucleic Acid
gccgcggcggaggaaacucccuucaaggacaucguccgggagcuccug

SEQ ID NO: 7665 - RNA, 48 nt, Artificial Sequence
  Description of Artificial Sequence:  Enzymatic Nucleic Acid
ugccgcggggaggaaacucccuucaaggacaucguccgggcagcuccu

SEQ ID NO: 7666 - RNA, 48 nt, Artificial Sequence
  Description of Artificial Sequence:  Enzymatic Nucleic Acid
aggugccgggaggaaacucccuucaaggacaucguccgggggccagcu

SEQ ID NO: 7667 - RNA, 48 nt, Artificial Sequence
  Description of Artificial Sequence:  Enzymatic Nucleic Acid
uaaggugcggaggaaacucccuucaaggacaucguccggggcggccag

SEQ ID NO: 7668 - RNA, 48 nt, Artificial Sequence
  Description of Artificial Sequence:  Enzymatic Nucleic Acid
guaaggugggaggaaacucccuucaaggacaucguccgggcgcggcca

SEQ ID NO: 7669 - RNA, 48 nt, Artificial Sequence
  Description of Artificial Sequence:  Enzymatic Nucleic Acid
agcugaagggaggaaacucccuucaaggacaucguccgggguaaggug

SEQ ID NO: 7670 - RNA, 48 nt, Artificial Sequence
  Description of Artificial Sequence:  Enzymatic Nucleic Acid
aucaacagggaggaaacucccuucaaggacaucguccgggugaagcgu

SEQ ID NO: 7671 - RNA, 48 nt, Artificial Sequence
  Description of Artificial Sequence:  Enzymatic Nucleic Acid
cggaucaaggaggaaacucccuucaaggacaucguccgggagcugaag

SEQ ID NO: 7672 - RNA, 48 nt, Artificial Sequence
  Description of Artificial Sequence:  Enzymatic Nucleic Acid
cagcggauggaggaaacucccuucaaggacaucguccgggaacagcug

SEQ ID NO: 7673 - RNA, 48 nt, Artificial Sequence
  Description of Artificial Sequence:  Enzymatic Nucleic Acid
gggaccagggaggaaacucccuucaaggacaucguccgggggaucaac

SEQ ID NO: 7674 - RNA, 48 nt, Artificial Sequence
  Description of Artificial Sequence:  Enzymatic Nucleic Acid
gaggggacggaggaaacucccuucaaggacaucguccgggagcggauc

SEQ ID NO: 7675 - RNA, 48 nt, Artificial Sequence
  Description of Artificial Sequence:  Enzymatic Nucleic Acid
agaggggaggaggaaacucccuucaaggacaucguccgggcagcggau

SEQ ID NO: 7676 - RNA, 48 nt, Artificial Sequence
  Description of Artificial Sequence:  Enzymatic Nucleic Acid
aucuacccggaggaaacucccuucaaggacaucguccgggaaaagagg

SEQ ID NO: 7677 - RNA, 48 nt, Artificial Sequence
  Description of Artificial Sequence:  Enzymatic Nucleic Acid
caucuaccggaggaaacucccuucaaggacaucguccgggcaaaagag

SEQ ID NO: 7678 - RNA, 48 nt, Artificial Sequence
  Description of Artificial Sequence:  Enzymatic Nucleic Acid
gcaucuacggaggaaacucccuucaaggacaucguccgggccaaaaga

SEQ ID NO: 7679 - RNA, 48 nt, Artificial Sequence
  Description of Artificial Sequence:  Enzymatic Nucleic Acid
cgcaucuaggaggaaacucccuucaaggacaucguccgggcccaaaag

SEQ ID NO: 7680 - RNA, 48 nt, Artificial Sequence
  Description of Artificial Sequence:  Enzymatic Nucleic Acid
ggccgcauggaggaaacucccuucaaggacaucguccggguaccccaa

SEQ ID NO: 7681 - RNA, 48 nt, Artificial Sequence
  Description of Artificial Sequence:  Enzymatic Nucleic Acid
cggggccgggaggaaacucccuucaaggacaucguccgggaucuaccc

SEQ ID NO: 7682 - RNA, 48 nt, Artificial Sequence
  Description of Artificial Sequence:  Enzymatic Nucleic Acid
aucggggcggaggaaacucccuucaaggacaucguccggggcaucuac

SEQ ID NO: 7683 - RNA, 48 nt, Artificial Sequence
  Description of Artificial Sequence:  Enzymatic Nucleic Acid
gaucggggggaggaaacucccuucaaggacaucguccgggcgcaucua

SEQ ID NO: 7684 - RNA, 48 nt, Artificial Sequence
  Description of Artificial Sequence:  Enzymatic Nucleic Acid
ggccugauggaggaaacucccuucaaggacaucguccgggggggccgc

SEQ ID NO: 7685 - RNA, 48 nt, Artificial Sequence
  Description of Artificial Sequence:  Enzymatic Nucleic Acid
agucaggcggaggaaacucccuucaaggacaucguccgggugaucggg

SEQ ID NO: 7686 - RNA, 48 nt, Artificial Sequence
  Description of Artificial Sequence:  Enzymatic Nucleic Acid
gagucaggggaggaaacucccuucaaggacaucguccgggcugaucgg

SEQ ID NO: 7687 - RNA, 48 nt, Artificial Sequence
  Description of Artificial Sequence:  Enzymatic Nucleic Acid
cagcgaguggaggaaacucccuucaaggacaucguccgggaggccuga

SEQ ID NO: 7688 - RNA, 48 nt, Artificial Sequence
  Description of Artificial Sequence:  Enzymatic Nucleic Acid
aagagcagggaggaaacucccuucaaggacaucguccggggagucagg

SEQ ID NO: 7689 - RNA, 48 nt, Artificial Sequence
  Description of Artificial Sequence:  Enzymatic Nucleic Acid
aaaaagagggaggaaacucccuucaaggacaucguccgggagcgaguc

SEQ ID NO: 7690 - RNA, 48 nt, Artificial Sequence
  Description of Artificial Sequence:  Enzymatic Nucleic Acid
gaagggaaggaggaaacucccuucaaggacaucguccgggaaaaagag

SEQ ID NO: 7691 - RNA, 48 nt, Artificial Sequence
  Description of Artificial Sequence:  Enzymatic Nucleic Acid
cgagcagaggaggaaacucccuucaaggacaucguccgggagaaggga

SEQ ID NO: 7692 - RNA, 48 nt, Artificial Sequence
  Description of Artificial Sequence:  Enzymatic Nucleic Acid
gguucgagggaggaaacucccuucaaggacaucguccgggagacagaa

SEQ ID NO: 7693 - RNA, 48 nt, Artificial Sequence
  Description of Artificial Sequence:  Enzymatic Nucleic Acid
aagugguuggaggaaacucccuucaaggacaucguccggggagcagac

SEQ ID NO: 7694 - RNA, 48 nt, Artificial Sequence
  Description of Artificial Sequence:  Enzymatic Nucleic Acid
gcccgaggggaggaaacucccuucaaggacaucguccgggaagugguu

SEQ ID NO: 7695 - RNA, 48 nt, Artificial Sequence
  Description of Artificial Sequence:  Enzymatic Nucleic Acid
gauuagccggaggaaacucccuucaaggacaucguccggggaggcaag

SEQ ID NO: 7696 - RNA, 48 nt, Artificial Sequence
  Description of Artificial Sequence:  Enzymatic Nucleic Acid
ggauuagcggaggaaacucccuucaaggacaucguccgggcgaggcaa

SEQ ID NO: 7697 - RNA, 48 nt, Artificial Sequence
  Description of Artificial Sequence:  Enzymatic Nucleic Acid
gggauuagggaggaaacucccuucaaggacaucguccgggccgaggca

SEQ ID NO: 7698 - RNA, 48 nt, Artificial Sequence
  Description of Artificial Sequence:  Enzymatic Nucleic Acid
cccagugcggaggaaacucccuucaaggacaucguccgggggguggag

SEQ ID NO: 7699 - RNA, 48 nt, Artificial Sequence
  Description of Artificial Sequence:  Enzymatic Nucleic Acid
ccccagugggaggaaacucccuucaaggacaucguccgggcgggugga

SEQ ID NO: 7700 - RNA, 48 nt, Artificial Sequence
  Description of Artificial Sequence:  Enzymatic Nucleic Acid
gacuucccggaggaaacucccuucaaggacaucguccgggagugccgg

SEQ ID NO: 7701 - RNA, 48 nt, Artificial Sequence
  Description of Artificial Sequence:  Enzymatic Nucleic Acid
ugacuuccggaggaaacucccuucaaggacaucguccgggcagugccg

SEQ ID NO: 7702 - RNA, 48 nt, Artificial Sequence
  Description of Artificial Sequence:  Enzymatic Nucleic Acid
uugacuucggaggaaacucccuucaaggacaucguccgggccagugcc

SEQ ID NO: 7703 - RNA, 48 nt, Artificial Sequence
  Description of Artificial Sequence:  Enzymatic Nucleic Acid
cuugacuuggaggaaacucccuucaaggacaucguccgggcccagugc

SEQ ID NO: 7704 - RNA, 48 nt, Artificial Sequence
  Description of Artificial Sequence:  Enzymatic Nucleic Acid
auucuugaggaggaaacucccuucaaggacaucguccggguuccccag

SEQ ID NO: 7705 - RNA, 48 nt, Artificial Sequence
  Description of Artificial Sequence:  Enzymatic Nucleic Acid
gccccauuggaggaaacucccuucaaggacaucguccggguugacuuc

SEQ ID NO: 7706 - RNA, 48 nt, Artificial Sequence
  Description of Artificial Sequence:  Enzymatic Nucleic Acid
ccaggcccggaggaaacucccuucaaggacaucguccgggauucuuga

SEQ ID NO: 7707 - RNA, 48 nt, Artificial Sequence
  Description of Artificial Sequence:  Enzymatic Nucleic Acid
cccaggccggaggaaacucccuucaaggacaucguccgggcauucuug

SEQ ID NO: 7708 - RNA, 48 nt, Artificial Sequence
  Description of Artificial Sequence:  Enzymatic Nucleic Acid
ccccaggcggaggaaacucccuucaaggacaucguccgggccauucuu

SEQ ID NO: 7709 - RNA, 48 nt, Artificial Sequence
  Description of Artificial Sequence:  Enzymatic Nucleic Acid
gccccaggggaggaaacucccuucaaggacaucguccgggcccauucu

SEQ ID NO: 7710 - RNA, 48 nt, Artificial Sequence
  Description of Artificial Sequence:  Enzymatic Nucleic Acid
gagagcccggaggaaacucccuucaaggacaucguccgggaggcccca

SEQ ID NO: 7711 - RNA, 48 nt, Artificial Sequence
  Description of Artificial Sequence:  Enzymatic Nucleic Acid
ugagagccggaggaaacucccuucaaggacaucguccgggcaggcccc

SEQ ID NO: 7712 - RNA, 48 nt, Artificial Sequence
  Description of Artificial Sequence:  Enzymatic Nucleic Acid
cugagagcggaggaaacucccuucaaggacaucguccgggccaggccc

SEQ ID NO: 7713 - RNA, 48 nt, Artificial Sequence
  Description of Artificial Sequence:  Enzymatic Nucleic Acid
ccugagagggaggaaacucccuucaaggacaucguccgggcccaggcc

SEQ ID NO: 7714 - RNA, 48 nt, Artificial Sequence
  Description of Artificial Sequence:  Enzymatic Nucleic Acid
aguucuccggaggaaacucccuucaaggacaucguccgggugagagcc

SEQ ID NO: 7715 - RNA, 48 nt, Artificial Sequence
  Description of Artificial Sequence:  Enzymatic Nucleic Acid
caguucucggaggaaacucccuucaaggacaucguccgggcugagagc

SEQ ID NO: 7716 - RNA, 48 nt, Artificial Sequence
  Description of Artificial Sequence:  Enzymatic Nucleic Acid
gcaguucuggaggaaacucccuucaaggacaucguccgggccugagag

SEQ ID NO: 7717 - RNA, 48 nt, Artificial Sequence
  Description of Artificial Sequence:  Enzymatic Nucleic Acid
aagcaguuggaggaaacucccuucaaggacaucguccgggucccugag

SEQ ID NO: 7718 - RNA, 48 nt, Artificial Sequence
  Description of Artificial Sequence:  Enzymatic Nucleic Acid
aggggaagggaggaaacucccuucaaggacaucguccgggaguucucc

SEQ ID NO: 7719 - RNA, 48 nt, Artificial Sequence
  Description of Artificial Sequence:  Enzymatic Nucleic Acid
agcucugcggaggaaacucccuucaaggacaucguccgggaggggaag

SEQ ID NO: 7720 - RNA, 48 nt, Artificial Sequence
  Description of Artificial Sequence:  Enzymatic Nucleic Acid
cagcucugggaggaaacucccuucaaggacaucguccgggcaggggaa

SEQ ID NO: 7721 - RNA, 48 nt, Artificial Sequence
  Description of Artificial Sequence:  Enzymatic Nucleic Acid
acccagcuggaggaaacucccuucaaggacaucguccgggugccaggg

SEQ ID NO: 7722 - RNA, 48 nt, Artificial Sequence
  Description of Artificial Sequence:  Enzymatic Nucleic Acid
ccacccagggaggaaacucccuucaaggacaucguccgggucugccag

SEQ ID NO: 7723 - RNA, 48 nt, Artificial Sequence
  Description of Artificial Sequence:  Enzymatic Nucleic Acid
cugccaccggaggaaacucccuucaaggacaucguccgggagcucugc

SEQ ID NO: 7724 - RNA, 48 nt, Artificial Sequence
  Description of Artificial Sequence:  Enzymatic Nucleic Acid
gcugccacggaggaaacucccuucaaggacaucguccgggcagcucug

SEQ ID NO: 7725 - RNA, 48 nt, Artificial Sequence
  Description of Artificial Sequence:  Enzymatic Nucleic Acid
agcugccaggaggaaacucccuucaaggacaucguccgggccagcucu

SEQ ID NO: 7726 - RNA, 48 nt, Artificial Sequence
  Description of Artificial Sequence:  Enzymatic Nucleic Acid
agagcugcggaggaaacucccuucaaggacaucguccgggacccagcu

SEQ ID NO: 7727 - RNA, 48 nt, Artificial Sequence
  Description of Artificial Sequence:  Enzymatic Nucleic Acid
aagagcugggaggaaacucccuucaaggacaucguccgggcacccagc

SEQ ID NO: 7728 - RNA, 48 nt, Artificial Sequence
  Description of Artificial Sequence:  Enzymatic Nucleic Acid
aggaagagggaggaaacucccuucaaggacaucguccgggugccaccc

SEQ ID NO: 7729 - RNA, 48 nt, Artificial Sequence
  Description of Artificial Sequence:  Enzymatic Nucleic Acid
ucggugucggaggaaacucccuucaaggacaucguccgggggugggag

SEQ ID NO: 7730 - RNA, 48 nt, Artificial Sequence
  Description of Artificial Sequence:  Enzymatic Nucleic Acid
gucgguguggaggaaacucccuucaaggacaucguccgggcgguggga

SEQ ID NO: 7731 - RNA, 48 nt, Artificial Sequence
  Description of Artificial Sequence:  Enzymatic Nucleic Acid
gggcggguggaggaaacucccuucaaggacaucguccggggguguccg

SEQ ID NO: 7732 - RNA, 48 nt, Artificial Sequence
  Description of Artificial Sequence:  Enzymatic Nucleic Acid
gcggcgggggaggaaacucccuucaaggacaucguccggggggucggu

SEQ ID NO: 7733 - RNA, 48 nt, Artificial Sequence
  Description of Artificial Sequence:  Enzymatic Nucleic Acid
cacagcggggaggaaacucccuucaaggacaucguccggggggcgggu

SEQ ID NO: 7734 - RNA, 48 nt, Artificial Sequence
  Description of Artificial Sequence:  Enzymatic Nucleic Acid
gggcacagggaggaaacucccuucaaggacaucguccgggggcgggcg

SEQ ID NO: 7735 - RNA, 48 nt, Artificial Sequence
  Description of Artificial Sequence:  Enzymatic Nucleic Acid
ccagggcaggaggaaacucccuucaaggacaucguccgggagcggcgg

SEQ ID NO: 7736 - RNA, 48 nt, Artificial Sequence
  Description of Artificial Sequence:  Enzymatic Nucleic Acid
ucccagggggaggaaacucccuucaaggacaucguccgggacagcggc

SEQ ID NO: 7737 - RNA, 48 nt, Artificial Sequence
  Description of Artificial Sequence:  Enzymatic Nucleic Acid
agcacuccggaggaaacucccuucaaggacaucguccgggagggcaca

SEQ ID NO: 7738 - RNA, 48 nt, Artificial Sequence
  Description of Artificial Sequence:  Enzymatic Nucleic Acid
cagcacucggaggaaacucccuucaaggacaucguccgggcagggcac

SEQ ID NO: 7739 - RNA, 48 nt, Artificial Sequence
  Description of Artificial Sequence:  Enzymatic Nucleic Acid
gcagcacuggaggaaacucccuucaaggacaucguccgggccagggca

SEQ ID NO: 7740 - RNA, 48 nt, Artificial Sequence
  Description of Artificial Sequence:  Enzymatic Nucleic Acid
gggcagcaggaggaaacucccuucaaggacaucguccgggucccaggg

SEQ ID NO: 7741 - RNA, 48 nt, Artificial Sequence
  Description of Artificial Sequence:  Enzymatic Nucleic Acid
gagggcagggaggaaacucccuucaaggacaucguccgggacucccag

SEQ ID NO: 7742 - RNA, 48 nt, Artificial Sequence
  Description of Artificial Sequence:  Enzymatic Nucleic Acid
uaagagggggaggaaacucccuucaaggacaucguccgggagcacucc

SEQ ID NO: 7743 - RNA, 48 nt, Artificial Sequence
  Description of Artificial Sequence:  Enzymatic Nucleic Acid
cccgugugggaggaaacucccuucaaggacaucguccgggaugguaag

SEQ ID NO: 7744 - RNA, 48 nt, Artificial Sequence
  Description of Artificial Sequence:  Enzymatic Nucleic Acid
agagcaccggaggaaacucccuucaaggacaucguccggggugugcau

SEQ ID NO: 7745 - RNA, 48 nt, Artificial Sequence
  Description of Artificial Sequence:  Enzymatic Nucleic Acid
gagagcacggaggaaacucccuucaaggacaucguccgggcgugugca

SEQ ID NO: 7746 - RNA, 48 nt, Artificial Sequence
  Description of Artificial Sequence:  Enzymatic Nucleic Acid
ggagagcaggaggaaacucccuucaaggacaucguccgggccgugugc

SEQ ID NO: 7747 - RNA, 48 nt, Artificial Sequence
  Description of Artificial Sequence:  Enzymatic Nucleic Acid
aaggagagggaggaaacucccuucaaggacaucguccgggacccgugu

SEQ ID NO: 7748 - RNA, 48 nt, Artificial Sequence
  Description of Artificial Sequence:  Enzymatic Nucleic Acid
augcagccggaggaaacucccuucaaggacaucguccgggaaaaggag

SEQ ID NO: 7749 - RNA, 48 nt, Artificial Sequence
  Description of Artificial Sequence:  Enzymatic Nucleic Acid
caugcagcggaggaaacucccuucaaggacaucguccgggcaaaagga

SEQ ID NO: 7750 - RNA, 48 nt, Artificial Sequence
  Description of Artificial Sequence:  Enzymatic Nucleic Acid
gcaugcagggaggaaacucccuucaaggacaucguccgggccaaaagg

SEQ ID NO: 7751 - RNA, 48 nt, Artificial Sequence
  Description of Artificial Sequence:  Enzymatic Nucleic Acid
auagcaugggaggaaacucccuucaaggacaucguccgggagcccaaa

SEQ ID NO: 7752 - RNA, 48 nt, Artificial Sequence
  Description of Artificial Sequence:  Enzymatic Nucleic Acid
uggaauagggaggaaacucccuucaaggacaucguccgggaugcagcc

SEQ ID NO: 7753 - RNA, 48 nt, Artificial Sequence
  Description of Artificial Sequence:  Enzymatic Nucleic Acid
ucuggcugggaggaaacucccuucaaggacaucguccgggaaaaugga

SEQ ID NO: 7754 - RNA, 48 nt, Artificial Sequence
  Description of Artificial Sequence:  Enzymatic Nucleic Acid
cggucuggggaggaaacucccuucaaggacaucguccgggugcaaaau

SEQ ID NO: 7755 - RNA, 48 nt, Artificial Sequence
  Description of Artificial Sequence:  Enzymatic Nucleic Acid
acaucgguggaggaaacucccuucaaggacaucguccggguggcugca

SEQ ID NO: 7756 - RNA, 48 nt, Artificial Sequence
  Description of Artificial Sequence:  Enzymatic Nucleic Acid
auacacauggaggaaacucccuucaaggacaucguccgggggucuggc

SEQ ID NO: 7757 - RNA, 48 nt, Artificial Sequence
  Description of Artificial Sequence:  Enzymatic Nucleic Acid
uaaauacaggaggaaacucccuucaaggacaucguccgggaucggucu

SEQ ID NO: 7758 - RNA, 48 nt, Artificial Sequence
  Description of Artificial Sequence:  Enzymatic Nucleic Acid
guuaaauaggaggaaacucccuucaaggacaucguccgggacaucggu

SEQ ID NO: 7759 - RNA, 48 nt, Artificial Sequence
  Description of Artificial Sequence:  Enzymatic Nucleic Acid
aauagugaggaggaaacucccuucaaggacaucguccgggugguuaaa

SEQ ID NO: 7760 - RNA, 48 nt, Artificial Sequence
  Description of Artificial Sequence:  Enzymatic Nucleic Acid
auguccauggaggaaacucccuucaaggacaucguccgggaauaguga

SEQ ID NO: 7761 - RNA, 48 nt, Artificial Sequence
  Description of Artificial Sequence:  Enzymatic Nucleic Acid
caaaugucggaggaaacucccuucaaggacaucguccgggaucaauag

SEQ ID NO: 7762 - RNA, 48 nt, Artificial Sequence
  Description of Artificial Sequence:  Enzymatic Nucleic Acid
ccaaauguggaggaaacucccuucaaggacaucguccgggcaucaaua

SEQ ID NO: 7763 - RNA, 48 nt, Artificial Sequence
  Description of Artificial Sequence:  Enzymatic Nucleic Acid
aaacaaccggaggaaacucccuucaaggacaucguccgggaaaugucc

SEQ ID NO: 7764 - RNA, 48 nt, Artificial Sequence
  Description of Artificial Sequence:  Enzymatic Nucleic Acid
gaaacaacggaggaaacucccuucaaggacaucguccgggcaaauguc

SEQ ID NO: 7765 - RNA, 48 nt, Artificial Sequence
  Description of Artificial Sequence:  Enzymatic Nucleic Acid
ggaaacaaggaggaaacucccuucaaggacaucguccgggccaaaugu

SEQ ID NO: 7766 - RNA, 48 nt, Artificial Sequence
  Description of Artificial Sequence:  Enzymatic Nucleic Acid
augggaaaggaggaaacucccuucaaggacaucguccgggaacccaaa

SEQ ID NO: 7767 - RNA, 48 nt, Artificial Sequence
  Description of Artificial Sequence:  Enzymatic Nucleic Acid
uaugguaaggaggaaacucccuucaaggacaucguccgggaaaaagau

SEQ ID NO: 7768 - RNA, 48 nt, Artificial Sequence
  Description of Artificial Sequence:  Enzymatic Nucleic Acid
uacuaugcggaggaaacucccuucaaggacaucguccgggauuauuua

SEQ ID NO: 7769 - RNA, 48 nt, Artificial Sequence
  Description of Artificial Sequence:  Enzymatic Nucleic Acid
uuacuaugggaggaaacucccuucaaggacaucguccgggcauuauuu

SEQ ID NO: 7770 - RNA, 48 nt, Artificial Sequence
  Description of Artificial Sequence:  Enzymatic Nucleic Acid
uuuuuuuaggaggaaacucccuucaaggacaucguccggguaugccau

SEQ ID NO: 7771 - RNA, 15 nt, Homo sapiens
uuuacauuucaaguu

SEQ ID NO: 7772 - RNA, 15 nt, Homo sapiens
ucaaguuauaauaga

SEQ ID NO: 7773 - RNA, 15 nt, Homo sapiens
gccaaauuagcuguu

SEQ ID NO: 7774 - RNA, 15 nt, Homo sapiens
ccaaauuagcuguug

SEQ ID NO: 7775 - RNA, 13 nt, Homo sapiens
uuggcucaggugg

SEQ ID NO: 7776 - RNA, 15 nt, Homo sapiens
auuggcucaggugga

SEQ ID NO: 7777 - RNA, 13 nt, Homo sapiens
uggaauucuguga

SEQ ID NO: 7778 - RNA, 15 nt, Homo sapiens
auggaauucugugau

SEQ ID NO: 7779 - RNA, 13 nt, Homo sapiens
agagaucuuaagc

SEQ ID NO: 7780 - RNA, 13 nt, Homo sapiens
gacgauugcaauc

SEQ ID NO: 7781 - RNA, 15 nt, Homo sapiens
acaccguuggaucgc

SEQ ID NO: 7782 - RNA, 13 nt, Homo sapiens
uugcccagaagaa

SEQ ID NO: 7783 - RNA, 15 nt, Homo sapiens
ggaauucugugauaa

SEQ ID NO: 7784 - RNA, 13 nt, Homo sapiens
gagaucuuaagcc

SEQ ID NO: 7785 - RNA, 15 nt, Homo sapiens
agagaucuuaagcca

SEQ ID NO: 7786 - RNA, 13 nt, Homo sapiens
acuggcauacaug

SEQ ID NO: 7787 - RNA, 15 nt, Homo sapiens
cauucgcuaaaugag

SEQ ID NO: 7788 - RNA, 13 nt, Homo sapiens
gagaaggcggagc

SEQ ID NO: 7789 - RNA, 13 nt, Homo sapiens
ccguacguuaaga

SEQ ID NO: 7790 - RNA, 15 nt, Homo sapiens
acgaagaguuaccuu

SEQ ID NO: 7791 - RNA, 15 nt, Homo sapiens
agagguuuggcaugg

SEQ ID NO: 7792 - RNA, 15 nt, Homo sapiens
gggaccuuggaacaa

SEQ ID NO: 7793 - RNA, 15 nt, Homo sapiens
aaggaguaagggaac

SEQ ID NO: 7794 - RNA, 15 nt, Homo sapiens
ccuggcucaucucuu

SEQ ID NO: 7795 - RNA, 15 nt, Homo sapiens
gaucguucucugccu

SEQ ID NO: 7796 - RNA, 15 nt, Homo sapiens
uacucgcugucuguc

SEQ ID NO: 7797 - RNA, 15 nt, Homo sapiens
gcaguucuuccaucu

SEQ ID NO: 7798 - RNA, 15 nt, Homo sapiens
augagcccagaacag

SEQ ID NO: 7799 - RNA, 15 nt, Homo sapiens
cuggcucaucucuuu

SEQ ID NO: 7800 - RNA, 15 nt, Homo sapiens
aucguucucugccuc

SEQ ID NO: 7801 - RNA, 15 nt, Homo sapiens
acucgcugucuguca

SEQ ID NO: 7802 - RNA, 15 nt, Homo sapiens
cgggggugcaugggc

SEQ ID NO: 7803 - RNA, 15 nt, Homo sapiens
acaauuggccgcuaa

SEQ ID NO: 7804 - RNA, 15 nt, Homo sapiens
acuaccuguccucug

SEQ ID NO: 7805 - RNA, 15 nt, Homo sapiens
acuacgugugagucc

SEQ ID NO: 7806 - RNA, 15 nt, Homo sapiens
ugcgugcauuuugga

SEQ ID NO: 7807 - RNA, 15 nt, Homo sapiens
uggaacaauggauug

SEQ ID NO: 7808 - RNA, 15 nt, Homo sapiens
ucaaguaauccaccu

SEQ ID NO: 7809 - RNA, 15 nt, Homo sapiens
aggugaagguagauc

SEQ ID NO: 7810 - RNA, 15 nt, Homo sapiens
aacaauuggccgcua

SEQ ID NO: 7811 - RNA, 15 nt, Homo sapiens
ccuuccugacaugaa

SEQ ID NO: 7812 - RNA, 15 nt, Homo sapiens
uuuuccuggcucauc

SEQ ID NO: 7813 - RNA, 15 nt, Homo sapiens
aguuccucaugugca

SEQ ID NO: 7814 - RNA, 13 nt, Homo sapiens
gcggauaucuaca

SEQ ID NO: 7815 - RNA, 15 nt, Homo sapiens
ggcggauaucuacaa

SEQ ID NO: 7816 - RNA, 15 nt, Homo sapiens
cggauaucuacaagg

SEQ ID NO: 7817 - RNA, 13 nt, Homo sapiens
auaucuacaaggc

SEQ ID NO: 7818 - RNA, 15 nt, Homo sapiens
uacaugucauggagu

SEQ ID NO: 7819 - RNA, 15 nt, Homo sapiens
agugcauugaguagg

SEQ ID NO: 7820 - RNA, 13 nt, Homo sapiens
acgacucggagcu

SEQ ID NO: 7821 - RNA, 15 nt, Homo sapiens
ucugagucaggcgac

SEQ ID NO: 7822 - RNA, 13 nt, Homo sapiens
ugcagcccagugg

SEQ ID NO: 7823 - RNA, 13 nt, Homo sapiens
gcagcccaguggu

SEQ ID NO: 7824 - RNA, 13 nt, Homo sapiens
cccuccagcgcug

SEQ ID NO: 7825 - RNA, 13 nt, Homo sapiens
agaaucaagagcu

SEQ ID NO: 7826 - RNA, 15 nt, Homo sapiens
gagaaucaagagcuc

SEQ ID NO: 7827 - RNA, 13 nt, Homo sapiens
gauggcugaggac

SEQ ID NO: 7828 - RNA, 15 nt, Homo sapiens
agauggcugaggaca

SEQ ID NO: 7829 - RNA, 15 nt, Homo sapiens
acaaggccucuguga

SEQ ID NO: 7830 - RNA, 13 nt, Homo sapiens
ggccucugugaaa

SEQ ID NO: 7831 - RNA, 15 nt, Homo sapiens
ugaaagcccagguga

SEQ ID NO: 7832 - RNA, 13 nt, Homo sapiens
guggaccagcugc

SEQ ID NO: 7833 - RNA, 13 nt, Homo sapiens
ugcagcuggaaga

SEQ ID NO: 7834 - RNA, 15 nt, Homo sapiens
augcagcuggaagau

SEQ ID NO: 7835 - RNA, 13 nt, Homo sapiens
ggaggccgagcag

SEQ ID NO: 7836 - RNA, 15 nt, Homo sapiens
aggaggccgagcagc

SEQ ID NO: 7837 - RNA, 13 nt, Homo sapiens
agcagcacaagau

SEQ ID NO: 7838 - RNA, 15 nt, Homo sapiens
gagcagcacaagauu

SEQ ID NO: 7839 - RNA, 15 nt, Homo sapiens
gcagcacaagauugu

SEQ ID NO: 7840 - RNA, 15 nt, Homo sapiens
ggauaucuacaaggc

SEQ ID NO: 7841 - RNA, 13 nt, Homo sapiens
aggagcagcugga

SEQ ID NO: 7842 - RNA, 15 nt, Homo sapiens
aagugccaguaucag

SEQ ID NO: 7843 - RNA, 13 nt, Homo sapiens
caugucauggagu

SEQ ID NO: 7844 - RNA, 15 nt, Homo sapiens
acaugucauggagug

SEQ ID NO: 7845 - RNA, 13 nt, Homo sapiens
cacgucugcggaa

SEQ ID NO: 7846 - RNA, 15 nt, Homo sapiens
ucggaaccaggucug

SEQ ID NO: 7847 - RNA, 15 nt, Homo sapiens
cccuccagcgcugcc

SEQ ID NO: 7848 - RNA, 15 nt, Homo sapiens
cuccagcgcugccug

SEQ ID NO: 7849 - RNA, 13 nt, Homo sapiens
agcgcugccugga

SEQ ID NO: 7850 - RNA, 13 nt, Homo sapiens
ucaagagcuccga

SEQ ID NO: 7851 - RNA, 15 nt, Homo sapiens
aucaagagcuccgag

SEQ ID NO: 7852 - RNA, 13 nt, Homo sapiens
gccucugugaaag

SEQ ID NO: 7853 - RNA, 15 nt, Homo sapiens
ggccucugugaaagc

SEQ ID NO: 7854 - RNA, 13 nt, Homo sapiens
uggagagugagcg

SEQ ID NO: 7855 - RNA, 15 nt, Homo sapiens
caagauugugaugga

SEQ ID NO: 7856 - RNA, 13 nt, Homo sapiens
gaggaagcggcau

SEQ ID NO: 7857 - RNA, 15 nt, Homo sapiens
ugaggaagcggcaug

SEQ ID NO: 7858 - RNA, 15 nt, Homo sapiens
agugccaguaucagg

SEQ ID NO: 7859 - RNA, 13 nt, Homo sapiens
acuccggcguaga

SEQ ID NO: 7860 - RNA, 15 nt, Homo sapiens
gugacgcgugucaca

SEQ ID NO: 7861 - RNA, 15 nt, Homo sapiens
ugcaaguuccaggag

SEQ ID NO: 7862 - RNA, 15 nt, Homo sapiens
agggaguacagcaaa

SEQ ID NO: 7863 - RNA, 15 nt, Homo sapiens
ccuaccucuccucuc

SEQ ID NO: 7864 - RNA, 15 nt, Homo sapiens
cgcugcucuuuuugu

SEQ ID NO: 7865 - RNA, 15 nt, Homo sapiens
ggcagcucuuccucc

SEQ ID NO: 7866 - RNA, 15 nt, Homo sapiens
agcgugcagguggac

SEQ ID NO: 7867 - RNA, 15 nt, Homo sapiens
cagcugcagagggag

SEQ ID NO: 7868 - RNA, 15 nt, Homo sapiens
gccuaccucuccucu

SEQ ID NO: 7869 - RNA, 15 nt, Homo sapiens
uuguucccuucuguc

SEQ ID NO: 7870 - RNA, 15 nt, Homo sapiens
ugcugcccucuuacc

SEQ ID NO: 7871 - RNA, 15 nt, Homo sapiens
cagagaagugaggac

SEQ ID NO: 7872 - RNA, 15 nt, Homo sapiens
caucgaggucccauc

SEQ ID NO: 7873 - RNA, 15 nt, Homo sapiens
uucugcugucccaag

SEQ ID NO: 7874 - RNA, 15 nt, Homo sapiens
cugacucgcugcucu

SEQ ID NO: 7875 - RNA, 15 nt, Homo sapiens
cccuucugucugcuc

SEQ ID NO: 7876 - RNA, 15 nt, Homo sapiens
gcagcagaucaggac

SEQ ID NO: 7877 - RNA, 15 nt, Homo sapiens
ugaagagaugccagc

SEQ ID NO: 7878 - RNA, 15 nt, Homo sapiens
uccaagaauacgaca

SEQ ID NO: 7879 - RNA, 15 nt, Homo sapiens
aucucaaacagcagc

SEQ ID NO: 7880 - RNA, 15 nt, Homo sapiens
ggcagcagaucagga

SEQ ID NO: 7881 - RNA, 15 nt, Homo sapiens
cggaggagaagagga

SEQ ID NO: 7882 - RNA, 15 nt, Homo sapiens
acaggaggugaucga

SEQ ID NO: 7883 - RNA, 15 nt, Homo sapiens
ccugggagugcugcc

SEQ ID NO: 7884 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
aacuugacugaugaggccguuaggccgaaauguaaan

SEQ ID NO: 7885 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
ucuauuacugaugaggccguuaggccgaaaacuugan

SEQ ID NO: 7886 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
aacagcucugaugaggccguuaggccgaaauuuggcn

SEQ ID NO: 7887 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
caacagccugaugaggccguuaggccgaaaauuuggn

SEQ ID NO: 7888 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
ccaccucugaugaggccguuaggccgaaagccaan

SEQ ID NO: 7889 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
uccaccucugaugaggccguuaggccgaaagccaaun

SEQ ID NO: 7890 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
ucacagcugaugaggccguuaggccgaaauuccan

SEQ ID NO: 7891 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
aucacagcugaugaggccguuaggccgaaauuccaun

SEQ ID NO: 7892 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
gcuuaacugaugaggccguuaggccgaaaucucun

SEQ ID NO: 7893 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
gauugccuagugacgccguuaggcggaaaucgucn

SEQ ID NO: 7894 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (30)..(30): n stands for inosine
  misc_feature (37)..(37): n stands for inverted deoxyabasic derivative
gcgaucccuagugaggccguuaggccgaancggugun

SEQ ID NO: 7895 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (29)..(29): n stands for inosine
  misc_feature (35)..(35): n stands for inverted deoxyabasic derivative
uucuuccugaugaggccguuaggccgaanggcaan

SEQ ID NO: 7896 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (30)..(30): n stands for inosine
  misc_feature (37)..(37): n stands for inverted deoxyabasic derivative
uuaucaccugaugaggccguuaggccgaanaauuccn

SEQ ID NO: 7897 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (29)..(29): n stands for inosine
  misc_feature (35)..(35): n stands for inverted deoxyabasic derivative
ggcuuacugaugaggccguuaggccgaanaucucn

SEQ ID NO: 7898 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (30)..(30): n stands for inosine
  misc_feature (37)..(37): n stands for inverted deoxyabasic derivative
uggcuuacugaugaggccguuaggccgaanaucucun

SEQ ID NO: 7899 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (29)..(29): n stands for inosine
  misc_feature (35)..(35): n stands for inverted deoxyabasic derivative
cauguacuagugacgccguuaggcggaanccagun

SEQ ID NO: 7900 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (30)..(30): n stands for inosine
  misc_feature (37)..(37): n stands for inverted deoxyabasic derivative
cucauuucuagugacgccguuaggcggaancgaaugn

SEQ ID NO: 7901 - RNA, 34 nt, Artificial Sequence
  Description of Artificial Sequence:  Enzymatic Nucleic Acid
  misc_feature (1)..(15): 2'-O-Methyl
  misc_feature (17)..(22): 2'-O-Methyl
  misc_feature (24)..(25): 2'-O-Methyl
  misc_feature (27)..(33): 2'-O-Methyl
  misc_feature (1)..(4): Phosphorothioate 3'-Internucleotide Linkage
  misc_feature (16)..(16): 2'-deoxy-2'-amino
  misc_feature (26)..(26): 2'-deoxy-2'-amino
  misc_feature (34)..(34): n stands for inverted deoxyabasic derivative
gcuccggccgaaaggcgagugaggucucuucucn

SEQ ID NO: 7902 - RNA, 34 nt, Artificial Sequence
  Description of Artificial Sequence:  Enzymatic Nucleic Acid
  misc_feature (1)..(15): 2'-O-Methyl
  misc_feature (17)..(17): 2'-O-Methyl
  misc_feature (19)..(20): 2'-O-Methyl
  misc_feature (22)..(33): 2'-O-Methyl
  misc_feature (1)..(4): Phosphorothioate 3'-Internucleotide Linkage
  misc_feature (16)..(16): 2'-deoxy-2'-amino
  misc_feature (18)..(18): 2'-deoxy-2'-amino
  misc_feature (34)..(34): n stands for inverted deoxyabasic derivative
ucuuaagccgaaaggcucuggagugagguacggn

SEQ ID NO: 7903 - RNA, 36 nt, Artificial Sequence
  Description of Artificial Sequence:  Enzymatic Nucleic Acid
  misc_feature (1)..(16): 2'-O-Methyl
  misc_feature (18)..(18): 2'-O-Methyl
  misc_feature (20)..(21): 2'-O-Methyl
  misc_feature (23)..(35): 2'-O-Methyl
  misc_feature (1)..(4): Phosphorothioate 3'-Internucleotide Linkage
  misc_feature (17)..(17): 2'-deoxy-2'-amino
  misc_feature (19)..(19): 2'-deoxy-2'-amino
  misc_feature (36)..(36): n stands for inverted deoxyabasic derivative
aagguaagccgaaaggcucuggagugagucuucgun

SEQ ID NO: 7904 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
ccaugcccugaugaggccguuaggccgaaaaccucun

SEQ ID NO: 7905 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
uuguucccugaugaggccguuaggccgaaaggucccn

SEQ ID NO: 7906 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
guucccucugaugaggccguuaggccgaaacuccuun

SEQ ID NO: 7907 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
aagagaucugaugaggccguuaggccgaaagccaggn

SEQ ID NO: 7908 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
aggcagacugaugaggccguuaggccgaaaacgaucn

SEQ ID NO: 7909 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
gacagaccugaugaggccguuaggccgaancgaguan

SEQ ID NO: 7910 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
agauggacugaugaggccguuaggccgaanaacugcn

SEQ ID NO: 7911 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
cuguucucugaugaggccguuaggccgaangcucaun

SEQ ID NO: 7912 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
aaagagacugaugaggccguuaggccgaanagccagn

SEQ ID NO: 7913 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
gaggcagcugaugaggccguuaggccgaanaacgaun

SEQ ID NO: 7914 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
ugacagagccgaaaggcgagugaggucuagcgagun

SEQ ID NO: 7915 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
gcccauggccgaaaggcgagugaggucuacccccgn

SEQ ID NO: 7916 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
uuagcgggccgaaaggcgagugaggucucaauugun

SEQ ID NO: 7917 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
cagaggagccgaaaggcgagugaggucuagguagun

SEQ ID NO: 7918 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
ggacucagccgaaaggcgagugaggucuacguagun

SEQ ID NO: 7919 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
uccaaaaggctagctacaacgagcacgcan

SEQ ID NO: 7920 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
cagaggaggctagctacaacgaagguagun

SEQ ID NO: 7921 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
caauccaggctagctacaacgauguuccan

SEQ ID NO: 7922 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
aaagagaggctagctacaacgagagccagn

SEQ ID NO: 7923 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
agguggaggctagctacaacgauacuugan

SEQ ID NO: 7924 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
gaucuacggaggaaacucccuucaaggacaucguccggguucaccun

SEQ ID NO: 7925 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
uagcggcggaggaaacucccuucaaggacaucguccgggaauuguun

SEQ ID NO: 7926 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
cagaggaggaggaaacucccuucaaggacaucguccgggagguagun

SEQ ID NO: 7927 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
uucauguggaggaaacucccuucaaggacaucguccgggaggaaggn

SEQ ID NO: 7928 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
gaugagcggaggaaacucccuucaaggacaucguccgggaggaaaan

SEQ ID NO: 7929 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
ugcacaucugaugaggccguuaggccgaaaggaacun

SEQ ID NO: 7930 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
uguagacugaugaggccguuaggccgaaauccgcn

SEQ ID NO: 7931 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
uuguagacugaugaggccguuaggccgaaauccgccn

SEQ ID NO: 7932 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
ccuuguacugaugaggccguuaggccgaaauauccgn

SEQ ID NO: 7933 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
gccuugcugaugaggccguuaggccgaaagauaun

SEQ ID NO: 7934 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
acuccaucugaugaggccguuaggccgaaacauguan

SEQ ID NO: 7935 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
ccuacuccugaugaggccguuaggccgaaaugcacun

SEQ ID NO: 7936 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (1)..(4): Phosphorothioate 3'-Internucleotide Linkage
  misc_feature (8)..(8): 2'-deoxy-2'-C-Allyl
  misc_feature (35)..(35): n stands for inverted deoxyabasic derivative
agcucccuagugacgccguuaggcggaaagucgun

SEQ ID NO: 7937 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (1)..(4): Phosphorothioate 3'-Internucleotide Linkage
  misc_feature (9)..(9): 2'-deoxy-2'-C-Allyl
  misc_feature (37)..(37): n stands for inverted deoxyabasic derivative
gucgccucuagugacgccguuaggcggaaacucagan

SEQ ID NO: 7938 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
ccacugcugaugaggccguuaggccgaancugcan

SEQ ID NO: 7939 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
accacucugaugaggccguuaggccgaangcugcn

SEQ ID NO: 7940 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
cagcgccugaugaggccguuaggccgaangagggn

SEQ ID NO: 7941 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
agcucucugaugaggccguuaggccgaanauucun

SEQ ID NO: 7942 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
gagcucucugaugaggccguuaggccgaanauucucn

SEQ ID NO: 7943 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
guccuccugaugaggccguuaggccgaanccaucn

SEQ ID NO: 7944 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
uguccuccugaugaggccguuaggccgaanccaucun

SEQ ID NO: 7945 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
ucacagacugaugaggccguuaggccgaanccuugun

SEQ ID NO: 7946 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
uuucaccugaugaggccguuaggccgaanaggccn

SEQ ID NO: 7947 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
ucaccugcugaugaggccguuaggccgaancuuucan

SEQ ID NO: 7948 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
gcagcucugaugaggccguuaggccgaanuccacn

SEQ ID NO: 7949 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
ucuucccugaugaggccguuaggccgaancugcan

SEQ ID NO: 7950 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
aucuucccugaugaggccguuaggccgaancugcaun

SEQ ID NO: 7951 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
cugcuccugaugaggccguuaggccgaanccuccn

SEQ ID NO: 7952 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
gcugcuccugaugaggccguuaggccgaanccuccun

SEQ ID NO: 7953 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
aucuugcugaugaggccguuaggccgaancugcun

SEQ ID NO: 7954 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
aaucuugcugaugaggccguuaggccgaancugcucn

SEQ ID NO: 7955 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
acaaucucugaugaggccguuaggccgaanugcugcn

SEQ ID NO: 7956 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
gccuugucugaugaggccguuaggccgaanauauccn

SEQ ID NO: 7957 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
uccagccugaugaggccguuaggccgaancuccun

SEQ ID NO: 7958 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
cugauaccugaugaggccguuaggccgaangcacuun

SEQ ID NO: 7959 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
acuccacugaugaggccguuaggccgaanacaugn

SEQ ID NO: 7960 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
cacuccacugaugaggccguuaggccgaanacaugun

SEQ ID NO: 7961 - RNA, 35 nt, Artificial Sequence
  Description of Artificial Sequence:  Enzymatic Nucleic Acid
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (29)..(29): n stands for inosine
  misc_feature (35)..(35): n stands for inverted deoxyabasic derivative
uuccgccuagugacgccguuaggcggaanacgugn

SEQ ID NO: 7962 - RNA, 37 nt, Artificial Sequence
  Description of Artificial Sequence:  Enzymatic Nucleic Acid
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (30)..(30): n stands for inosine
  misc_feature (37)..(37): n stands for inverted deoxyabasic derivative
cagaccucuagugacgccguuaggcggaanuuccgan

SEQ ID NO: 7963 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
ggcagcggccgaaaggcgagugaggucuuggagggn

SEQ ID NO: 7964 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
caggcaggccgaaaggcgagugaggucugcuggagn

SEQ ID NO: 7965 - RNA, 34 nt, Artificial Sequence
  Description of Artificial Sequence:  Enzymatic Nucleic Acid
  misc_feature (1)..(15): 2'-O-Methyl
  misc_feature (17)..(22): 2'-O-Methyl
  misc_feature (24)..(25): 2'-O-Methyl
  misc_feature (27)..(33): 2'-O-Methyl
  misc_feature (1)..(4): Phosphorothioate 3'-Internucleotide Linkage
  misc_feature (16)..(16): 2'-deoxy-2'-amino
  misc_feature (26)..(26): 2'-deoxy-2'-amino
  misc_feature (34)..(34): n stands for inverted deoxyabasic derivative
uccagggccgaaaggcgagugaggucuagcgcun

SEQ ID NO: 7966 - RNA, 34 nt, Artificial Sequence
  Description of Artificial Sequence:  Enzymatic Nucleic Acid
  misc_feature (1)..(15): 2'-O-Methyl
  misc_feature (17)..(22): 2'-O-Methyl
  misc_feature (24)..(25): 2'-O-Methyl
  misc_feature (27)..(33): 2'-O-Methyl
  misc_feature (1)..(4): Phosphorothioate 3'-Internucleotide Linkage
  misc_feature (16)..(16): 2'-deoxy-2'-amino
  misc_feature (26)..(26): 2'-deoxy-2'-amino
  misc_feature (34)..(34): n stands for inverted deoxyabasic derivative
ucggaggccgaaaggcgagugaggucuucuugan

SEQ ID NO: 7967 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
cucggaggccgaaaggcgagugaggucuucuugaun

SEQ ID NO: 7968 - RNA, 34 nt, Artificial Sequence
  Description of Artificial Sequence:  Enzymatic Nucleic Acid
  misc_feature (1)..(15): 2'-O-Methyl
  misc_feature (17)..(22): 2'-O-Methyl
  misc_feature (24)..(25): 2'-O-Methyl
  misc_feature (27)..(33): 2'-O-Methyl
  misc_feature (1)..(4): Phosphorothioate 3'-Internucleotide Linkage
  misc_feature (16)..(16): 2'-deoxy-2'-amino
  misc_feature (26)..(26): 2'-deoxy-2'-amino
  misc_feature (34)..(34): n stands for inverted deoxyabasic derivative
cuuucagccgaaaggcgagugaggucuagaggcn

SEQ ID NO: 7969 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
gcuuucagccgaaaggcgagugaggucuagaggccn

SEQ ID NO: 7970 - RNA, 34 nt, Artificial Sequence
  Description of Artificial Sequence:  Enzymatic Nucleic Acid
  misc_feature (1)..(15): 2'-O-Methyl
  misc_feature (17)..(22): 2'-O-Methyl
  misc_feature (24)..(25): 2'-O-Methyl
  misc_feature (27)..(33): 2'-O-Methyl
  misc_feature (1)..(4): Phosphorothioate 3'-Internucleotide Linkage
  misc_feature (16)..(16): 2'-deoxy-2'-amino
  misc_feature (26)..(26): 2'-deoxy-2'-amino
  misc_feature (34)..(34): n stands for inverted deoxyabasic derivative
cgcucagccgaaaggcgagugaggucuucuccan

SEQ ID NO: 7971 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
uccaucagccgaaaggcgagugaggucuaaucuugn

SEQ ID NO: 7972 - RNA, 34 nt, Artificial Sequence
  Description of Artificial Sequence:  Enzymatic Nucleic Acid
  misc_feature (1)..(15): 2'-O-Methyl
  misc_feature (17)..(22): 2'-O-Methyl
  misc_feature (24)..(25): 2'-O-Methyl
  misc_feature (27)..(33): 2'-O-Methyl
  misc_feature (1)..(4): Phosphorothioate 3'-Internucleotide Linkage
  misc_feature (16)..(16): 2'-deoxy-2'-amino
  misc_feature (26)..(26): 2'-deoxy-2'-amino
  misc_feature (34)..(34): n stands for inverted deoxyabasic derivative
augccggccgaaaggcgagugaggucuuuccucn

SEQ ID NO: 7973 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
caugccggccgaaaggcgagugaggucuuuccucan

SEQ ID NO: 7974 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (25)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-deoxy-2'-amino
  misc_feature (27)..(27): 2'-deoxy-2'-amino
  misc_feature (36)..(36): n stands for inverted deoxyabasic derivative
ccugauagccgaaaggcgagugaggucuuggcacun

SEQ ID NO: 7975 - RNA, 34 nt, Artificial Sequence
  Description of Artificial Sequence:  Enzymatic Nucleic Acid
  misc_feature (1)..(15): 2'-O-Methyl
  misc_feature (17)..(17): 2'-O-Methyl
  misc_feature (19)..(20): 2'-O-Methyl
  misc_feature (22)..(33): 2'-O-Methyl
  misc_feature (1)..(4): Phosphorothioate 3'-Internucleotide Linkage
  misc_feature (16)..(16): 2'-deoxy-2'-amino
  misc_feature (18)..(18): 2'-deoxy-2'-amino
  misc_feature (34)..(34): n stands for inverted deoxyabasic derivative
ucuacggccgaaaggcucuggagugagcggagun

SEQ ID NO: 7976 - RNA, 36 nt, Artificial Sequence
  Description of Artificial Sequence:  Enzymatic Nucleic Acid
  misc_feature (1)..(16): 2'-O-Methyl
  misc_feature (18)..(18): 2'-O-Methyl
  misc_feature (20)..(21): 2'-O-Methyl
  misc_feature (23)..(35): 2'-O-Methyl
  misc_feature (1)..(4): Phosphorothioate 3'-Internucleotide Linkage
  misc_feature (17)..(17): 2'-deoxy-2'-amino
  misc_feature (19)..(19): 2'-deoxy-2'-amino
  misc_feature (36)..(36): n stands for inverted deoxyabasic derivative
ugugacagccgaaaggcucuggagugaggcgucacn

SEQ ID NO: 7977 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
cuccuggcugaugaggccguuaggccgaaacuugcan

SEQ ID NO: 7978 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
uuugcugcugaugaggccguuaggccgaaacucccun

SEQ ID NO: 7979 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
gagaggacugaugaggccguuaggccgaaagguaggn

SEQ ID NO: 7980 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
acaaaaacugaugaggccguuaggccgaaagcagcgn

SEQ ID NO: 7981 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (37)..(37): n stands for inverted deoxyabasic derivative
ggaggaacugaugaggccguuaggccgaaagcugccn

SEQ ID NO: 7982 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
guccacccugaugaggccguuaggccgaancacgcun

SEQ ID NO: 7983 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
cucccuccugaugaggccguuaggccgaancagcugn

SEQ ID NO: 7984 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
agaggagcugaugaggccguuaggccgaanguaggcn

SEQ ID NO: 7985 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
gacagaacugaugaggccguuaggccgaangaacaan

SEQ ID NO: 7986 - RNA, 37 nt, Artificial Sequence
  Description of Artificial Sequence:  Enzymatic Nucleic Acid
  misc_feature (1)..(7): 2'-O-Methyl
  misc_feature (15)..(26): 2'-O-Methyl
  misc_feature (31)..(36): 2'-O-Methyl
  misc_feature (30)..(30): n stands for inosine
  misc_feature (37)..(37): n stands for inverted deoxyabasic derivative
gguaagacugaugaggccguuaggccgaangcagcan

SEQ ID NO: 7987 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
guccucagccgaaaggcgagugaggucuuucucugn

SEQ ID NO: 7988 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
gaugggagccgaaaggcgagugaggucucucgaugn

SEQ ID NO: 7989 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
cuugggagccgaaaggcgagugaggucuagcagaan

SEQ ID NO: 7990 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
agagcaggccgaaaggcgagugaggucugagucagn

SEQ ID NO: 7991 - RNA, 36 nt, Artificial Sequence
  Description of Artificial Sequence:  Enzymatic Nucleic Acid
  misc_feature (1)..(16): 2'-O-Methyl
  misc_feature (18)..(23): 2'-O-Methyl
  misc_feature (26)..(26): 2'-O-Methyl
  misc_feature (28)..(35): 2'-O-Methyl
  misc_feature (17)..(17): 2'-deoxy-2'-amino
  misc_feature (27)..(27): 2'-deoxy-2'-amino
  misc_feature (36)..(36): n stands for inverted deoxyabasic derivative
gagcagagccgaaaggcgagugaggucuagaagggn

SEQ ID NO: 7992 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
guccucaggctagctacaacgauucucugn

SEQ ID NO: 7993 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
guccugaggctagctacaacgacugcugcn

SEQ ID NO: 7994 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
gcuggcaggctagctacaacgacucuucan

SEQ ID NO: 7995 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
ugucguaggctagctacaacgaucuuggan

SEQ ID NO: 7996 - DNA, 30 bp, Artificial Sequence
  Description of Artificial Sequence:  Enzymatic Nucleic Acid
  misc_feature (1)..(7): 2'-O-Methyl
  misc_feature (23)..(29): 2'-O-Methyl
  misc_feature (30)..(30): n stands for inverted deoxyabasic derivative
gcugcugggctagctacaacgauugagaun

SEQ ID NO: 7997 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
guccucaggaggaaacucccuucaaggacaucguccggguucucugn

SEQ ID NO: 7998 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
uccugauggaggaaacucccuucaaggacaucguccgggugcugccn

SEQ ID NO: 7999 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
uccucuuggaggaaacucccuucaaggacaucguccggguccuccgn

SEQ ID NO: 8000 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
ucgaucaggaggaaacucccuucaaggacaucguccgggcuccugun

SEQ ID NO: 8001 - RNA, 47 nt, Artificial Sequence
  Description of Artificial Sequence:  Enzymatic Nucleic Acid
  misc_feature (1)..(7): 2'-O-Methyl
  misc_feature (9)..(18): 2'-O-Methyl
  misc_feature (24)..(35): 2'-O-Methyl
  misc_feature (40)..(46): 2'-O-Methyl
  misc_feature (19)..(23): 2'-deoxy-2'-amino
  misc_feature (36)..(36): 2'-deoxy-2'-amino
  misc_feature (47)..(47): n stands for inverted deoxyabasic derivative
ggcagcaggaggaaacucccuucaaggacaucguccgggucccaggn

SEQ ID NO: 8002 - RNA, 10 nt, Artificial Sequence
  Description of Artificial Sequence:  Exemplary Stem II  motif
gccguuaggc

SEQ ID NO: 8003 - RNA, 15 nt, Artificial Sequence
  Description of Artificial Sequence:  Generic substrate sequence
  misc_feature (1)..(6): n stands for a, c, g, or u
  misc_feature (9)..(15): n stands for a, c, g, or u
nnnnnnuhnnnnnnn

SEQ ID NO: 8004 - RNA, 36 nt, Artificial Sequence
  Description of Artificial Sequence:  Enzymatic Nucleic Acid
  misc_feature (1)..(7): n stands for a, c, g, or u
  misc_feature (16)..(18): n stands for a, c, g, or u
  misc_feature (23)..(25): n stands for a, c, g, or u
  misc_feature (31)..(36): n stands for a, c, g, or u
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
nnnnnnncugaugagnnngaaannncgaaannnnnn

SEQ ID NO: 8005 - RNA, 14 nt, Artificial Sequence
  Description of Artificial Sequence:  Generic Substrate Sequence
  misc_feature (1)..(5): n stands for a, c, g, or u
  misc_feature (8)..(14): n stands for a, c, g, or u
nnnnnchnnnnnnn

SEQ ID NO: 8006 - RNA, 35 nt, Artificial Sequence
  Description of Artificial Sequence:  Enzymatic Nucleic Acid
  misc_feature (1)..(7): n stands for a, c, g, or u
  misc_feature (16)..(18): n stands for a, c, g, or u
  misc_feature (23)..(25): n stands for a, c, g, or u
  misc_feature (31)..(35): n stands for a, c, g, or u
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(35): 2'-O-Methyl
  misc_feature (30)..(30): n stands for Inosine
  misc_feature (9)..(9): 2'-deoxy-2'-C-Allyl
nnnnnnncugaugagnnngaaannncgaannnnnn

SEQ ID NO: 8007 - RNA, 15 nt, Artificial Sequence
  Description of Artificial Sequence:  Generic Substrate sequence
  misc_feature (1)..(6): n stands for a, c, g, or u
  misc_feature (9)..(15): n stands for a, c, g, or u
nnnnnnygnnnnnnn

SEQ ID NO: 8008 - RNA, 35 nt, Artificial Sequence
  Description of Artificial Sequence:  Enzymatic Nucleic Acid
  misc_feature (1)..(7): n stands for a, c, g, or u
  misc_feature (29)..(35): n stands for a, c, g, or u
  misc_feature (1)..(8): 2'-O-Methyl
  misc_feature (13)..(16): 2'-O-Methyl
  misc_feature (18)..(35): 2'-O-Methyl
  misc_feature (11)..(11): Phosphorothioate 3'-Internucleotide Linkage
nnnnnnnugauggcaugcacuaugcgcgnnnnnnn

SEQ ID NO: 8009 - RNA, 48 nt, Artificial Sequence
  Description of Artificial Sequence:  Enzymatic Nucleic Acid
  misc_feature (1)..(8): 2'-O-Methyl
  misc_feature (12)..(21): 2'-O-Methyl
  misc_feature (32)..(37): 2'-O-Methyl
  misc_feature (44)..(48): 2'-O-Methyl
  misc_feature (9)..(10): 2'-deoxy-2'-amino
  misc_feature (22)..(26): 2'-deoxy-2'-amino
  misc_feature (38)..(40): 2'-deoxy-2'-amino
gugugcaaccggaggaaacucccuucaaggacgaaaguccgggacggg

SEQ ID NO: 8010 - RNA, 16 nt, Artificial Sequence
  Description of Artificial Sequence:  Substrate sequence
gccguggguugcacac

SEQ ID NO: 8011 - RNA, 36 nt, Artificial Sequence
  Description of Artificial Sequence:  Enzymatic Nucleic Acid
  misc_feature (1)..(7): 2'-O-Methyl
  misc_feature (36)..(36): 3'-3' inverted abasic moiety
  misc_feature (9)..(15): 2'-O-Methyl
  misc_feature (19)..(19): 2'-O-Methyl
  misc_feature (21)..(21): 2'-O-Methyl
  misc_feature (23)..(23): 2'-O-Methyl
  misc_feature (26)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-Deoxy-2'-Amino
  misc_feature (27)..(27): 2'-Deoxy-2'-Amino
gugccuggccgaaaggcgagugaggucugccgcgcn

SEQ ID NO: 8012 - RNA, 15 nt, Artificial Sequence
  Description of Artificial Sequence:  Substrate sequence
gcgcggcgcaggcac

SEQ ID NO: 8013 - DNA, 16 bp, Artificial Sequence
  Description of Artificial Sequence:  Substrate sequence
rggctagctacaacga

SEQ ID NO: 8014 - DNA, 1994 bp, Homo sapiens
ggcacgagcatggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgcccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaaaaaaaaaaaaaaa

What I claim is:

1. A chemically modified double stranded siRNA molecule that down regulates expression of an IKK-gamma gene via RNA interference (RNAi), wherein:
    a) each strand of said siRNA molecule is independently about 18 to about 28 nucleotides in length; and
    b) one strand of said siRNA molecule comprises nucleotide sequence having sufficient complementarity to an RNA of said IKK-gamma gene for the siRNA molecule to direct cleavage of said RNA via RNA interference.

2. The siRNA molecule of claim 1, wherein each strand of the siRNA molecule comprises about 18 to about 28 nucleotides, and wherein each strand comprises at least about 14 to 24 nucleotides that are complementary to the nucleotides of the other strand.

3. The siRNA molecule of claim 1, wherein said siNA molecule is assembled from two separate oligonucleotide fragments wherein a first fragment comprises the sense strand and a second fragment comprises the antisense strand of said siNA molecule.

4. The siRNA molecule of claim 3, wherein said sense strand is connected to the antisense strand via a linker molecule.

5. The siRNA molecule of claim 4, wherein said linker molecule is a polynucleotide linker.

6. The siRNA molecule of claim 4, wherein said linker molecule is a non-nucleotide linker.

7. The siRNA molecule of claim 3, wherein said second fragment comprises a terminal cap moiety at a 5'-end, a 3'-end, or both of the 5' and 3' ends of said second strand.

8. The siRNA molecule of claim 7, wherein said terminal cap moiety is an inverted deoxy abasic moiety.

9. The siRNA molecule of claim 3, wherein said first fragment comprises a phosphorothioate internucleotide linkage at the 3' end of said first strand.

10. The siRNA molecule of claim 1, wherein said siRNA molecule comprises at least one 2'-sugar modification.

11. The siRNA molecule of claim 10, wherein said 2'-sugar modification is a 2'-deoxy-2'-fluoro modification.

12. The siRNA molecule of claim 10, wherein said 2'-sugar modification is a 2'-O-methyl modification.

13. The siRNA molecule of claim 10, wherein said 2'-sugar modification is a 2'-deoxy modification.

14. The siRNA molecule of claim 1, wherein said siRNA molecule comprises at least one nucleic acid base modification.

15. The siRNA molecule of claim 1, wherein said siRNA molecule comprises at least one phosphate backbone modification.

16. A composition comprising the siRNA molecule of claim 1 in a pharmaceutically acceptable carrier or diluent.

* * * * *

(12) EX PARTE REEXAMINATION CERTIFICATE (7175th)
United States Patent
McSwiggen

(10) Number: US 7,022,828 C1
(45) Certificate Issued: Nov. 17, 2009

(54) SIRNA TREATMENT OF DISEASES OR CONDITIONS RELATED TO LEVELS OF IKK-GAMMA

(75) Inventor: James A. McSwiggen, Boulder, CO (US)

(73) Assignee: Sirna Therapeutics Inc., Boulder, CO (US)

Reexamination Request:
No. 90/008,177, Aug. 22, 2006

Reexamination Certificate for:
Patent No.: 7,022,828
Issued: Apr. 4, 2006
Appl. No.: 10/156,306
Filed: May 28, 2002

Related U.S. Application Data
(60) Provisional application No. 60/294,412, filed on May 29, 2001.

(51) Int. Cl.
*C07H 21/02* (2006.01)

(52) U.S. Cl. .................. 536/23.1; 536/23.5
(58) Field of Classification Search .......... None
See application file for complete search history.

(56) References Cited

U.S. PATENT DOCUMENTS

| | | | |
|---|---|---|---|
| 5,998,203 A | 12/1999 | Matulic-Adamic et al. | 435/325 |
| 6,506,559 B1 * | 1/2003 | Fire et al. | 435/6 |
| 6,824,972 B2 | 11/2004 | Kenwrick et al. | 435/4 |

| | | | |
|---|---|---|---|
| 2002/0086356 A1 | 7/2002 | Tuschi et al. | 435/69.1 |

FOREIGN PATENT DOCUMENTS

| | | |
|---|---|---|
| WO | 94/01550 | 1/1994 |
| WO | 02/44321 | 6/2002 |

OTHER PUBLICATIONS

Elbashir et al (Nature, vol. 411, pp. 494–498, May 24, 2001).*
Bass (Nature, vol. 411, pp. 428–429, May 24, 2001).*
Krappmann et al., "The IκB kinase (IKK) complex is tripartite and contains IKKγ but not IKAP as a regular component." *J. Biol. Chem.* 275:29779–29787 (Sep. 22, 2000).
Levin H.L., "An unusual mechanism of self-primed reverse transcription requires the RNase H domain of reverse transcriptase to cleave an RNA duplex." *Mol. Cell Biol.* 16:5645–54 (Oct. 1996).
Smahi et al., "Genomic rearrangement in NEMO impairs NF–κB activation and is a cause of incontinentia pigmenti." *Nature* 405:466–72 (May 25, 2000).
Yamaoka et al., "Complementation cloning of NEMO, a component of the IκB kinase complex essential for NF–κB activation." *Cell* 93:1231–1240 (Jun. 26, 1998).

* cited by examiner

*Primary Examiner*—Padmashri Ponnaluri

(57) ABSTRACT

The present invention relates to nucleic acid molecules, including antisense and enzymatic nucleic acid molecules, such as hammerhead ribozymes, DNAzymes, allozymes, aptamers, decoys and siRNA (RNAi), which modulate the expression or function of IKK genes, such as IKK-gamma, IKK-alpha, or IKK-beta, and PKR genes.

EX PARTE REEXAMINATION CERTIFICATE ISSUED UNDER 35 U.S.C. 307

THE PATENT IS HEREBY AMENDED AS INDICATED BELOW.

AS A RESULT OF REEXAMINATION, IT HAS BEEN DETERMINED THAT:

Claims 1–16 are cancelled.

* * * * *